US 11,497,803 B2

(12) United States Patent
Kew et al.

(10) Patent No.: US 11,497,803 B2
(45) Date of Patent: Nov. 15, 2022

(54) MODULATION OF REPLICATIVE FITNESS BY DEOPTIMIZATION OF SYNONYMOUS CODONS

(71) Applicant: The Government of the USA as represented by the Secretary of the Dept. of Health and Human Services, Atlanta, GA (US)

(72) Inventors: Olen M. Kew, Alpharetta, GA (US); Cara Carthel Burns, Avondale Estates, GA (US); Jing Shaw, Decatur, GA (US); Raymond Campagnoli, Decatur, GA (US); Jacqueline Quay, Chapel Hill, NC (US)

(73) Assignee: The Government of the United States of America as represented by the Secretary of the Department of Health and Human Services, Centers for Disease Control and Prevention, Atlanta, GA (US)

( * ) Notice: Subject to any disclaimer, the term of this patent is extended or adjusted under 35 U.S.C. 154(b) by 0 days.

(21) Appl. No.: 15/931,336

(22) Filed: May 13, 2020

(65) Prior Publication Data
US 2020/0268865 A1  Aug. 27, 2020

Related U.S. Application Data

(62) Division of application No. 15/994,074, filed on May 31, 2018, now Pat. No. 10,695,414, which is a division of application No. 15/684,355, filed on Aug. 23, 2017, now abandoned, which is a division of application No. 14/464,619, filed on Aug. 20, 2014, now abandoned, which is a division of application No. 11/576,941, filed as application No. PCT/US2005/036241 on Oct. 7, 2005, now Pat. No. 8,846,051.

(60) Provisional application No. 60/617,545, filed on Oct. 8, 2004.

(51) Int. Cl.
*A61K 39/04* (2006.01)
*A61K 39/108* (2006.01)
*A61K 39/00* (2006.01)
*C07K 14/245* (2006.01)
*C12N 15/67* (2006.01)
*C12N 7/00* (2006.01)

(52) U.S. Cl.
CPC .......... *A61K 39/0258* (2013.01); *A61K 39/00* (2013.01); *C07K 14/245* (2013.01); *C12N 7/00* (2013.01); *C12N 15/67* (2013.01); *A61K 2039/522* (2013.01); *A61K 2039/5254* (2013.01); *C12N 2710/16162* (2013.01); *C12N 2710/16662* (2013.01); *C12N 2710/16762* (2013.01); *C12N 2760/16162* (2013.01); *C12N 2760/18462* (2013.01); *C12N 2760/18562* (2013.01); *C12N 2770/20062* (2013.01); *C12N 2770/24162* (2013.01); *C12N 2770/32162* (2013.01); *C12N 2770/32762* (2013.01); *C12N 2770/36262* (2013.01); *Y02A 50/30* (2018.01)

(58) Field of Classification Search
None
See application file for complete search history.

(56) References Cited

FOREIGN PATENT DOCUMENTS

| WO | WO 95/09249 | 4/1995 |
|---|---|---|
| WO | WO 02/077183 | 10/2002 |
| WO | WO 02/095363 | 11/2002 |

OTHER PUBLICATIONS

Gutman et al (Proc. Natl. Acad. Sci. USA. 86, 3699. 1989).*
Agashe et al., "Good Codons, Bad Transcript: Large Reductions in Gene Expression and Fitness Arising from Synonymous Mutations in a Key Enzyme," *Mol. Biol. Evol.*, vol. 30, No. 3, pp. 549-560, 2012.
Amino Acid and Codon Table (pdf); www.cbs.dtu.dk/courses/27619/codon.html; downloaded from internet by sws; Apr. 26, 2012.
Baltimore System Group IV viruses (pdf); copied from www.virology.net/Big_Virology/BVFamilyGroup.html#IV; created Aug. 26, 2012 by sws.
Baltimore System Group IV Viruses (pdf); downloaded from internet by ses; Apr. 26, 2012.
Bennetzen and Hall, "Codon Selection in Yeast," *J. Biol. Chem.* 257:3026-3031, 1982.
Bonekamp et al., "Translation Rates of Individual Codons Are Not Correlated with tRNA Abundances or with Frequencies of Utilization in *Escherichia coli,*" *Journal of Bacteriology*, vol. 171, No. 11, pp. 5812-5816, 1989.
Bradel-Tretheway et al., "Effects of codon-optimization on protein expression by the human herpesvirus 6 and 7 U51 open reading frame," *Journal of Virological Methods*, vol. 111, pp. 145-156, 2003.
Burns et al., "Modulation of Poliovirus Replicative Fitness in HeLa Cells by Deoptimization of Synonymous Codon Usage in the Capsid Region," *J. Virol.* vol. 80, pp. 3259-3272, 2006.

(Continued)

*Primary Examiner* — Jennifer E Graser
(74) *Attorney, Agent, or Firm* — Klarquist Sparkman, LLP

(57) ABSTRACT

Methods of producing a pathogen with reduced replicative fitness are disclosed, as are attenuated pathogens produced using the methods. In particular examples, the method includes deoptimizing one or more codons in a coding sequence, thereby reducing the replicative fitness of the pathogen. Methods of using the attenuated pathogens as immunogenic compositions are also disclosed.

12 Claims, 63 Drawing Sheets
Specification includes a Sequence Listing.

(56) References Cited

OTHER PUBLICATIONS

Carlini and Stephan, "In Vivo Introduction of Unpreferred Synonymous Codons into the *Drosophila* Adh Gene Results in Reduced Levels of ADH Protein," Genetics vol. 163, pp. 239-243, 2003.

Carter et al., "Transcription Attenuation in *Salmonella typhimurium*: The Significance of Rare Leucine Codons in the leu Leader," *Proc. Natl. Acad. Sci. USA*, vol. 83, No. 21, pp. 8127-8131, 1986.

Cherkasova et al., "Long-Term Circulation of Vaccine-Derived Poliovirus that Causes Paralytic Disease," *J. Virol.* vol. 76, pp. 6791-6799, 2002.

Christodoulou et al., "Mapping of Mutations Associated with Neurovirulence in Monkeys Infected with Sabin 1 Poliovirus Revertants Selected at High Temperature," *J. Virol.* vol. 64, pp. 4922-4929, 1990.

Dejiang et al., "Silencing of potato virus X coat protein gene in transgenic tobaccos by codon replacement that confers resistance to PVX infection," *Chinese Science Bulletin*, vol. 48, No. 15, pp. 1592-1598, 2003.

Eriani et al., "Isolation and Characterization of the Gene Coding for *Escherichia coli* arginyl-tRNA synthetase," *Nucl. Acids Res.*, vol. 17, No. 14, pp. 5725-5736, 1989.

Gavrilin et al., "Evolution of Circulating Wild Poliovirus and of Vaccine-Derived Poliovirus in an Immunodeficient Patient: a Unifying Model," *J. Virol.* vol. 74, pp. 7381-7390, 2000.

Georgescu et al., "Mapping of Mutations Contributing to the Temperature Sensitivity of the Sabin 1 Vaccine Strain of Poliovirus," *J. Virol.* vol. 69, pp. 5278-5286, 1995.

Hoekema et al., "Codon Replacement in the PKG1 Gene of *Saccharomyces cerevisiae*: Experimental Approach to Study the Role of Biased Codon Usage in Gene Expression," *Mol. Cell. Biol.* vol. 7, pp. 2914-2924, 1987.

Ikemura, "Codon Usage and tRNA Content in Unicellular and Multicellular Organisms," *Molecular Biology and Evolution*, vol. 2, No. 1, pp. 13-34, 1985.

Kew et al., "Prolonged Replication of a Type 1 Vaccine-Derived Poliovirus in an Immunodeficient Patient," *J Clin. Microbial*, vol. 36, No. 10, pp. 2893-2899, 1998.

Khetsuriani et al., "Persistence of Vaccine-Derived Polioviruses among Immunodeficient Persons with Vaccine-Associated Paralytic Poliomyelitis," *J. Infect. Dis.*, vol. 188, pp. 1845-1852, 2003.

Kinney et al., "Construction of Infectious cDNA Clones for Dengue 2 Virus: Strain 16681 and Its Attenuated Vaccine Derivative, Strain PDK-53," *Virology*, vol. 230, pp. 300-308, 1997.

Lamonica et al., "Mapping of Sequences Required for Mouse Neurovirulence of Poliovirus Type 2 Lansing," *J. Virol.*, vol. 57, No. 2, pp. 515-525, 1986.

Lee et al., "Novel Design Architecture for Genetic Stability of Recombinant Poliovirus: the Manipulation of G/C Contents and their Distribution Patterns Increases the Genetic Stability of Inserts in a Poliovirus-Based RPS-Vax Vector System," *J. Virol.*, vol. 76, pp. 1649-1662, 2002.

Lemm et al., "Mutations Which Alter the Level or Structure of nsP4 Can Affect the Efficiency of Sindbis Virus Replication in a Host-Dependent Manner," *J. Virol.*, vol. 64, pp. 3001-3011, 1990.

Macadam et al., "Genetic Basis of Attenuation of the Sabin Type 2 Vaccine Strain of Poliovirus in Primates," *Virology*, vol. 192, pp. 18-26, 1993.

Mueller et al., "Reduction of the rate of poliovirus protein synthesis through large-scale codon deoptimization causes attenuation of viral virulence by lowering specific infectivity," *J. Virol*, vol. 80, pp. 9687-9696, 2006.

Pevear et al., "Localization of genomic regions specific for the attenuated, mouse-adapted poliovirus type 2 strain W-2," *J. Gen. Virol.*, vol. 71, pp. 43-52, 1990.

Ramakrishna et al., "Codon Optimization of the Tat Antigen of Human Immunodeficiency Virus Type 1 Generates Strong Immune Responses in Mice Following Genetic Immunization," *J. Virol.*, vol. 78, pp. 9174-9189, 2004.

Ren et al., "Identification of Two Determinants that Attenuate Vaccine-Related Type 2 Poliovirus," *J. Virol.*, vol. 65, pp. 1377-1382, 1991.

Robinson et al., "Codon Usage Can Affect Efficiency of Translation of Genes in *Escherichia coli*," *Nucl. Acids Res.*, vol. 12, pp. 6663-6671, 1984.

Rothberg and Wimmer, "Mononucleotide and Dinucleotide Frequencies, and Codon Usage in Poliovirion RNA," *Nucl. Acids Res.*, vol. 9, pp. 6221-6229, 1981.

Sharp and Li, "The codon adaptation index - a measure of directional synonymous codon usage bias and its potential applications," *Nucl. Acids Res.*, vol. 15, No. 3, 1987.

Song et al., "High-level Expression of Codon Optimized Foot-and-Mouth Disease Virus Complex Epitopes and Cholera Toxin B Subunit Chimera in *Hansenula polymorpha*," *Biochem. Biophys. Res. Commun.*, vol. 315, pp. 235-239, 2004.

Statford et al., "Influence of Codon Usage on the Immunogenicity of a DNA Vaccine Against Tetanus," *Vaccine*, vol. 19, pp. 810-815, 2000.

Stenico et al., "Codon usage in Caenorhabditis elegans: delineation of translational selection and mutational biases," *Nucl. Acids Res.*, vol. 22, No. 13, pp. 2437-2446, 1994.

Tatem et al., "A Mutation Present in the Amino Terminus of Sabin 3 Poliovirus VP1 Protein is Attenuating," *J. Virol.*, vol. 66, pp. 3194-3197, 1992.

Wilmes-Riesenberg et al., "An Altered rpoS Allele Contributes to the Avirulence of *Salmonella typhimurium* LT2," *Infection and Immunity*, vol. 65, No. 1, pp. 203-210, 1997.

Zhou et al., "Papillomavirus Capsid Protein Expression Level Depends on the Match between Codon Usage and tRNA Availability," *J. Virol.*, vol. 73, pp. 4972-4982, 1999.

Zhu et al., "The Relationship Between the Gene Expression Level of Classical Swine Fever Virus and the Synonymous Codon Usage," *J. Wuhan Univ.* vol. 49, pp. 252-256, 2003 (including English translation).

\* cited by examiner

FIG. 1B (Sequence figure — nucleotide and amino acid sequence alignment, positions 640–1989, showing restriction sites BstZ17I and AvrII, and ORFs VP4, VP2, and VP3.)

```
                                                        ↓ XhoI
         AAG CCA AAG CAT GTC AGA GTC TGG TGC CCA CGA CCT CCA CGA GCA GTC CCA TAC TTC GGA CCA GGT GTT GAT TAT
3265     --- --+ --- --- --- +-- --- --- -+- --- --- --+ --- --- --- +-- --- --- -+- --- --- --+ --- --- ---     3339
             G             C G             G G     T
         K   P   K   H   V   R   V   W   C   P   R   P   P   R   A   V   P   Y   F   G   P   G   V   D   Y

AAA GAT GGG CTC ACC CCA CTA CCA GAA AAG GGA TTA ACG ACT TAT
3340     +-- --- --- -+- --- --- --+ --- --- +-- --- --- -+- ---       3384

K   D   G   L   T   P   L   P   E   K   G   L   T   T   Y
```

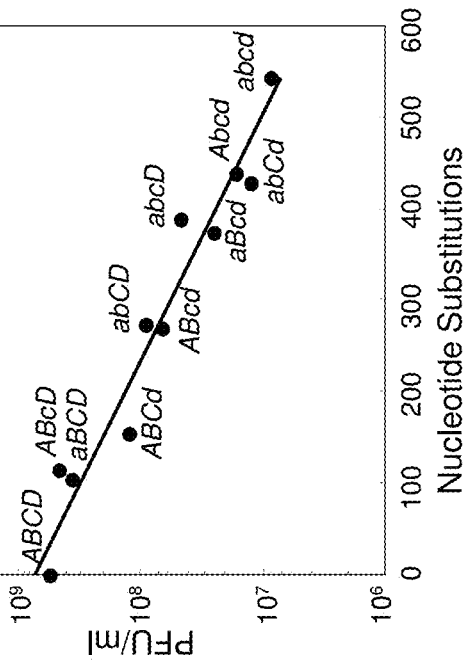
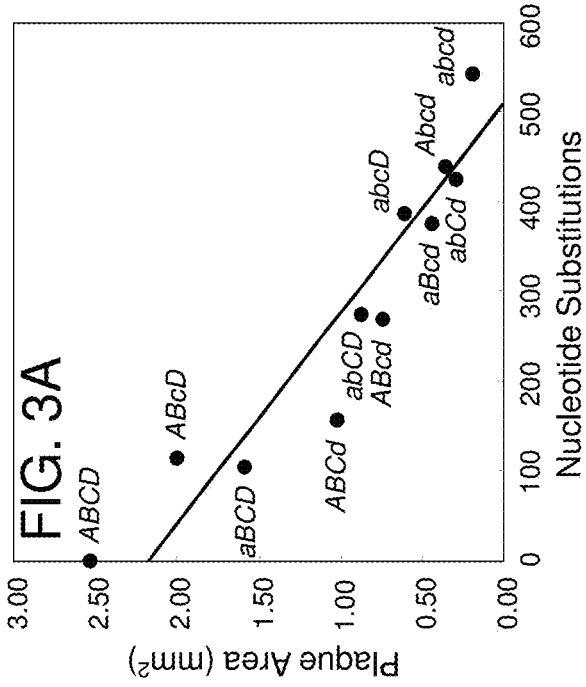
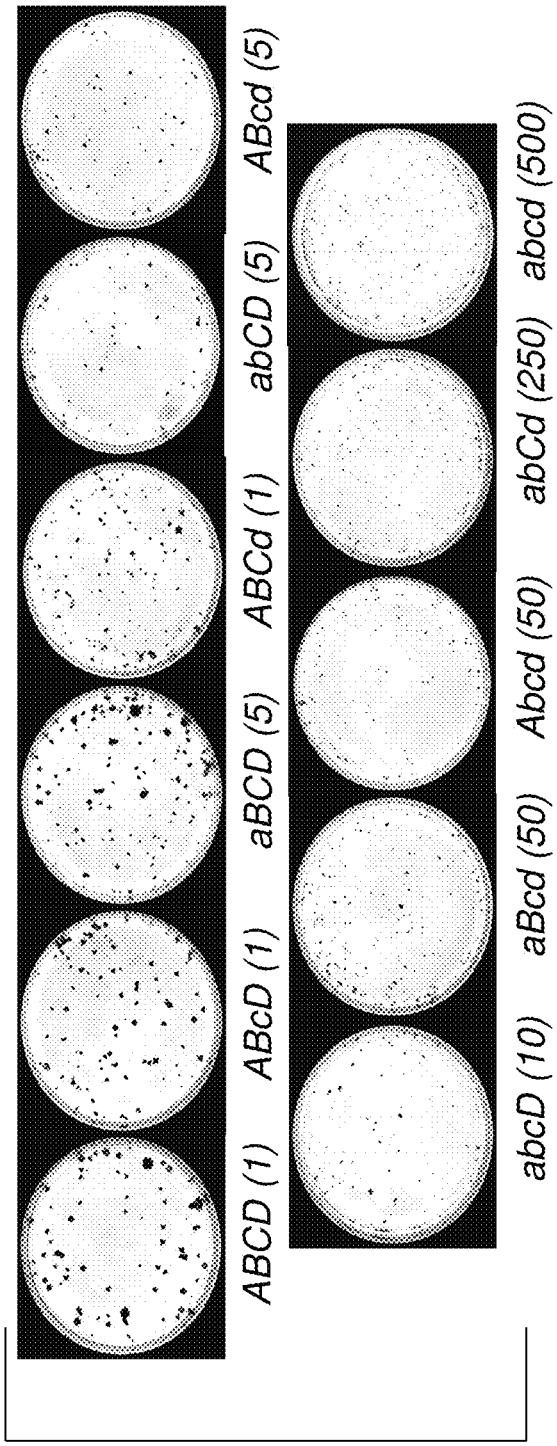
FIG. 3A
FIG. 3B
FIG. 3C

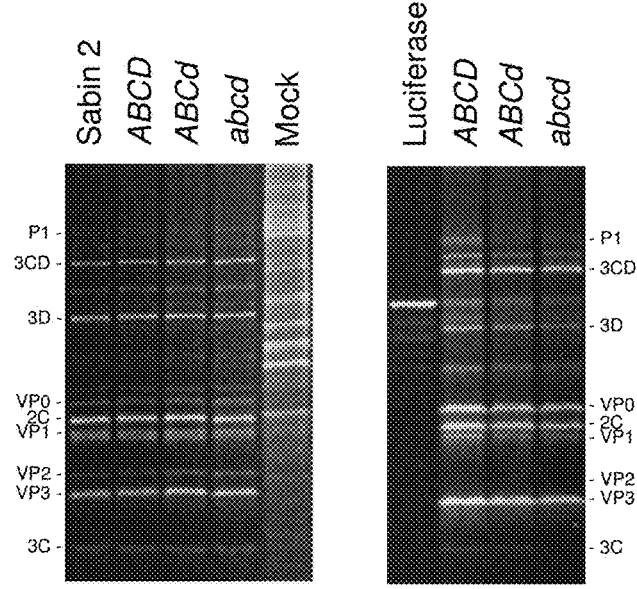
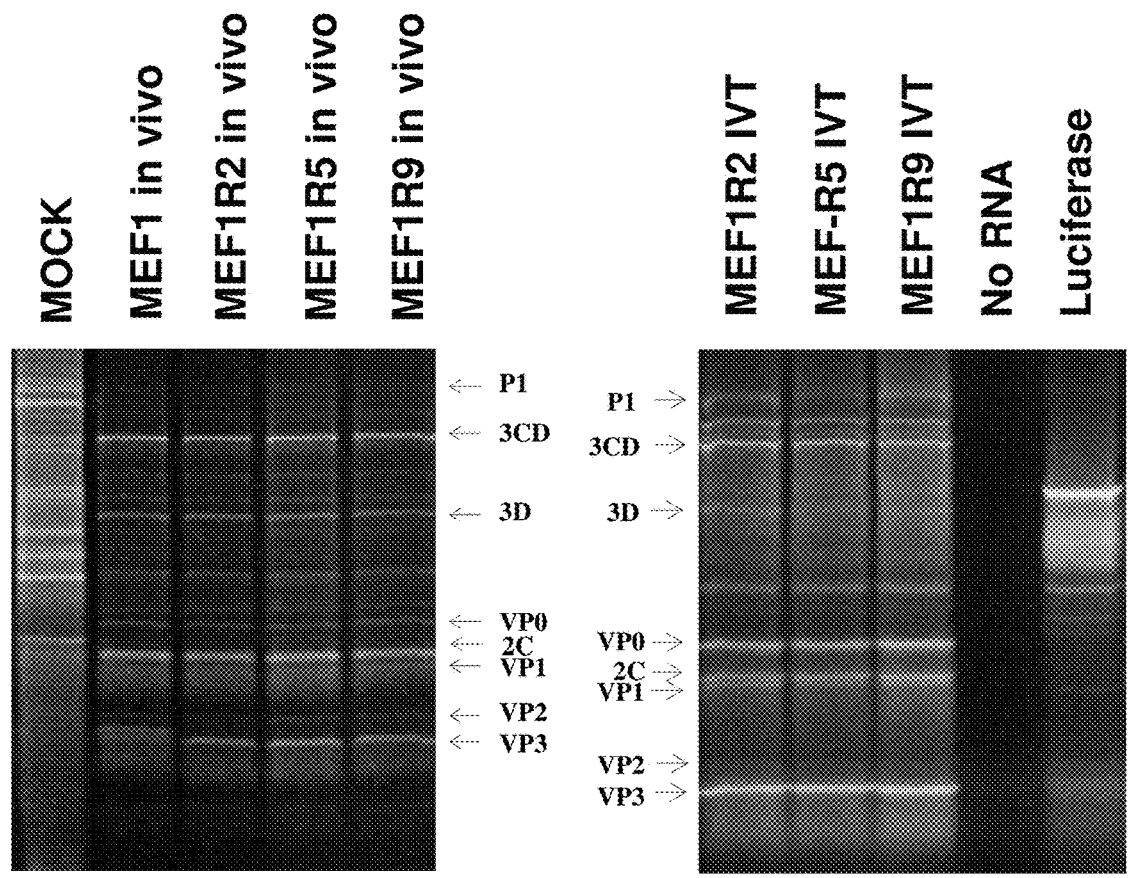
FIG. 5A  FIG. 5B
FIG. 5C  FIG. 5D

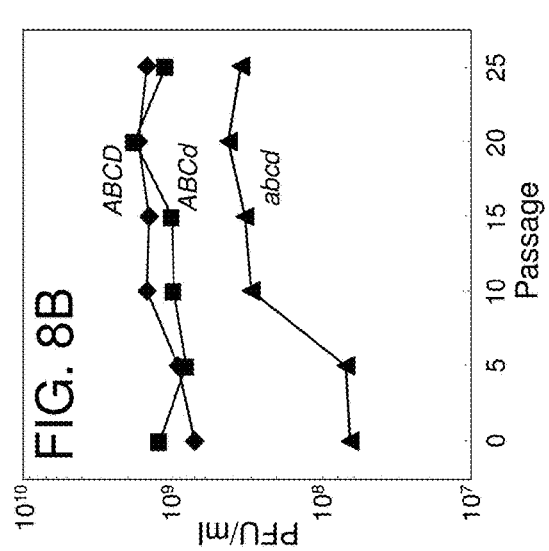
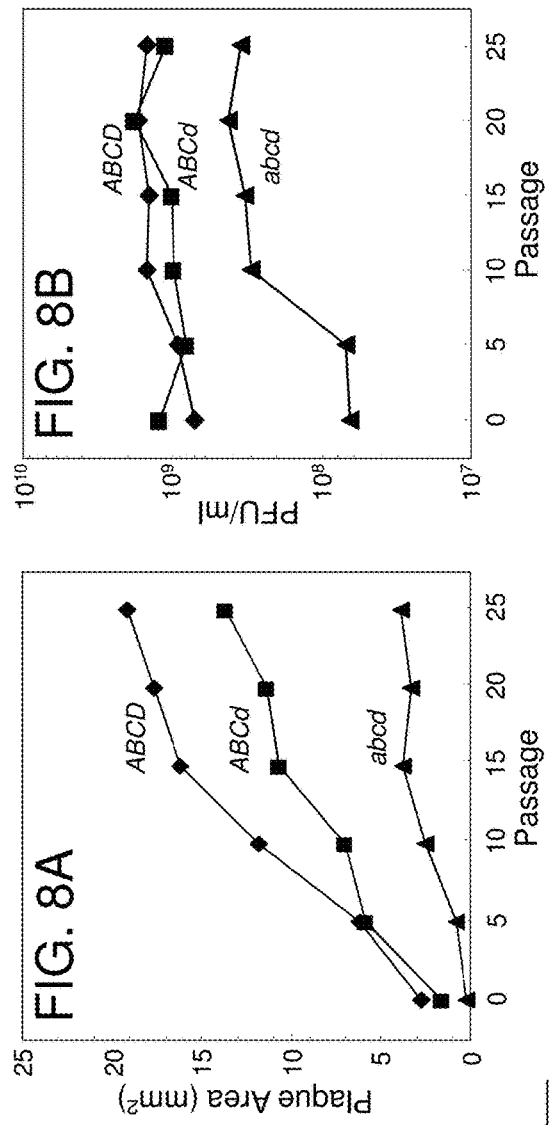
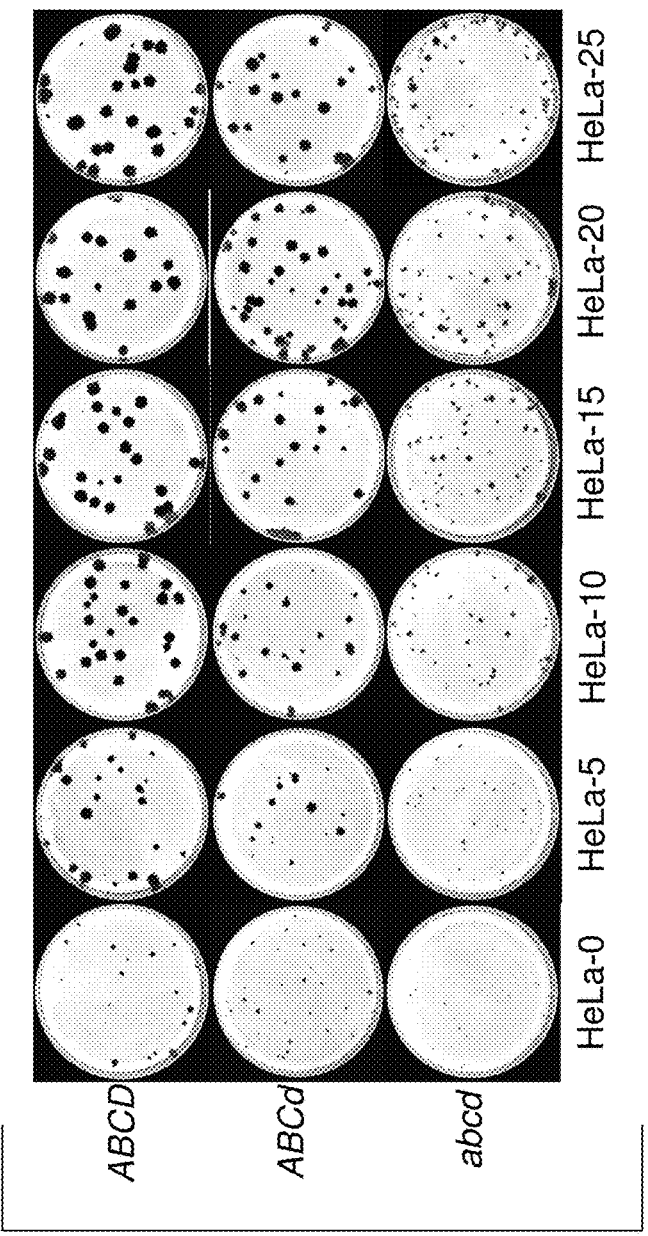

FIG. 9A
Poliovirus type 2, strain MEF1, complete open reading frame; all Arginine changed to CGG;
90 of 2207 (4.1%) codons changed, 139 of 6621 (2.1%) nucleotides changed (no change nt 4479 in cre element)
Sequence from MEF1 GenBank AY082677 (VP1 only from CDC)
Numbering (nt 748-7368) from GenBank AY238473 MEF1 (complete genome with 4 nt 1 aa different than CDC MEF1)

```
748
|
ATG GGC GCC CAA GTC TCA TCA CAG AAA GTT GGA GCC CAT GAG AAT TCA AAC AGA GCT TAT GGC GGA TCC ACC ATT
                                                                         C G
 M   G   A   Q   V   S   S   Q   K   V   G   A   H   E   N   S   N   R   A   Y   G   G   S   T   I

AAT TAC ACT ACT ATT AAT TAT TAC AGG GAT TCT GCG AGC AAT GCC GCT AGT AAG CAG GAC TTT GCA CAA GAC CCA
                                    C
 N   Y   T   T   I   N   Y   Y   R   D   S   A   S   N   A   A   S   K   Q   D   F   A   Q   D   P

TCC AAG TTC ACT GAA CCT ATT AAA GAT GTT CTC ATT AAG ACC GCT CCC ACG CTA AAC TCT CCT AAT ATC GAG GCG
 S   K   F   T   E   P   I   K   D   V   L   I   K   T   A   P   T   L   N   S   P   N   I   E   A

TGT GGG TAT AGC GAC AGA GTG ATG CAA CTA ACC CTA GGC AAT TCC ACC ATT ACC ACA CAG GAG GCG GCC AAT TCT
                         C G
 C   G   Y   S   D   R   V   M   Q   L   T   L   G   N   S   T   I   T   T   Q   E   A   A   N   S

GTC GTT GCA TAC GGC CGG TGG CCC GAG TAC ATC AAG GAC TCA GAA GCA AAT CCT GTG GAC CAG CCA ACT GAA CCG
 V   V   A   Y   G   R   W   P   E   Y   I   K   D   S   E   A   N   P   V   D   Q   P   T   E   P

GAC GTT GCC GCG TGC AGG TTT TAC ACA CTA GAC ACT GTT ACT TGG CGC AAG GAG TCC AGA GGG TGG TGG TGG AAA
                         C                                      G                  C G
 D   V   A   A   C   R   F   Y   T   L   D   T   V   T   W   R   K   E   S   R   G   W   W   W   K

CTG CCT GAT GCA CTA AAG GAC ATG GGA TTA TTC GGC CAG AAC ATG TTC TAC CAC TAC CTC GGG AGG GCT GGC TAT
                                                                                         C
 L   P   D   A   L   K   D   M   G   L   F   G   Q   N   M   F   Y   H   Y   L   G   R   A   G   Y

ACT GTG CAC GTA CAG TGT AAT GCT TCA AAG TTT CAC CAG GGC GCC CTC GGG GTA TTC GCA GTT CCA GAA ATG TGC
 T   V   H   V   Q   C   N   A   S   K   F   H   Q   G   A   L   G   V   F   A   V   P   E   M   C

CTG GCA GGC GAC AGC ACA ACC CAC ATG TTT ACA AAA TAT GAG AAT GCA AAT CCG GGT GAG AAA GGG GGT GAA TTC
 L   A   G   D   S   T   T   H   M   F   T   K   Y   E   N   A   N   P   G   E   K   G   G   E   F

AAA GGG AGT TTT ACT CTG GAT ACT AAC GCT ACC AAC CCT GCA CGC AAC TTT TGT CCC GTT GAT TAT CTC TTC GGG
                                                             G
 K   G   S   F   T   L   D   T   N   A   T   N   P   A   R   N   F   C   P   V   D   Y   L   F   G

AGC GGA GTA CTG GCG GGA AAT GCG TTT GTT TAC CCA CAT CAG ATA ATT AAT CTG CGC ACC AAC AAC TGT GCC ACG
                                                                             G
 S   G   V   L   A   G   N   A   F   V   Y   P   H   Q   I   I   N   L   R   T   N   N   C   A   T

TTG GTG CTG CCA TAC GTT AAT TCA CTT TCC ATA GAC AGC ATG ACA AAA CAC AAC AAT TGG GGA ATT GCT ATC CTT
 L   V   L   P   Y   V   N   S   L   S   I   D   S   M   T   K   H   N   N   W   G   I   A   I   L

CCG CTG GCA CCA CTT GAC TTT GCC ACC GAG TCC TCC ACT GAG ATA CCC ATT ACT CTA ACT ATT GCC CCT ATG TGT
 P   L   A   P   L   D   F   A   T   E   S   S   T   E   I   P   I   T   L   T   I   A   P   M   C

TGT GAA TTC AAT GGG TTG CGC AAC ATC ACT GTA CCC AGA ACT CAA GGG TTG CCA GTC TTA AAC ACT CCA GGA AGC
                             G                       C G
 C   E   F   N   G   L   R   N   I   T   V   P   R   T   Q   G   L   P   V   L   N   T   P   G   S

AAC CAG TAC TTA ACA GCA GAC AAC TAT CAA TCC CCA TGT GCG ATA CCC GAG TTT GAT GTA ACA CCA CCC ATA GAC
 N   Q   Y   L   T   A   D   N   Y   Q   S   P   C   A   I   P   E   F   D   V   T   P   P   I   D

ATC CCG GGG GAA GTG CGC AAC ATG ATG GAA TTG GCA GAG ATA GAC ACC ATG ATA CCT CTC AAT CTG ACG AAC CAG
                         G
 I   P   G   E   V   R   N   M   M   E   L   A   E   I   D   T   M   I   P   L   N   L   T   N   Q

CGC AAG AAC ACC ATG GAT ATG TAC AGA GTC GAA CTG AAT GAT GCG GCT CAC TCT GAC ACA CCA ATA TTG TGT CTC
   G                                C G
 R   K   N   T   M   D   M   Y   R   V   E   L   N   D   A   A   H   S   D   T   P   I   L   C   L

TCA CTG TCT CCA GCA TCA GAT CCT AGG CTA GCA CAC ACT ATG CTA GGT GAA ATA CTG AAC TAC TAC ACA CAC TGG
                                 C
 S   L   S   P   A   S   D   P   R   L   A   H   T   M   L   G   E   I   L   N   Y   Y   T   H   W
```

FIG. 9B

```
GCA GGG TCA TTG AAG TTC ACA TTT CTC TTC TGC GGC TCA ATG ATG GCC ACT GGT AAA TTG CTA GTG TCC TAT GCA
 A   G   S   L   K   F   T   F   L   F   C   G   S   M   M   A   T   G   K   L   L   V   S   Y   A

CCT CCT GGT GCG GAA GCC CCT AAA AGC CGC AAA GAA GCG ATG CTC GGC ACC CAC GTG ATC TGG GAC ATC GGA TTA
                                         G
 P   P   G   A   E   A   P   K   S   R   K   E   A   M   L   G   T   H   V   I   W   D   I   G   L

CAG TCA TCA TGC ACT ATG GTG GTA CCT TGG ATT AGC AAC ACC ACA TAC AGA CAA ACC ATC AAC GAT AGC TTC ACA
                                                                 C G
 Q   S   S   C   T   M   V   V   P   W   I   S   N   T   T   Y   R   Q   T   I   N   D   S   F   T

GAA GGA GGG TAC ATC AGT ATG TTT TAC CAA ACT AGA GTT GTT GTG CCA TTG TCC ACC CCT AGA AAG ATG GAC ATA
                                             C G                                   C G
 E   G   G   Y   I   S   M   F   Y   Q   T   R   V   V   V   P   L   S   T   P   R   K   M   D   I

TTG GGC TTT GTG TCA GCC TGC AAT GAC TTC AGT GTG CGC CTG TTG CGT GAC ACG ACG CAC ATA AGC CAA GAG GCT
                                                     G               G
 L   G   F   V   S   A   C   N   D   F   S   V   R   L   L   R   D   T   T   H   I   S   Q   E   A

ATG CCA CAA GGA TTG GGT GAT TTA ATT GAA GGG GTT GTT GAG GGA GTC ACG AGA AAT GCC TTG ACA CCA CTG ACA
                                                                     C G
 M   P   Q   G   L   G   D   L   I   E   G   V   V   E   G   V   T   R   N   A   L   T   P   L   T

CCT GCC AAC AAC TTG CCT GAT ACA CAA TCT AGC GGC CCA GCC CAC TCT AAG GAA ACA CCA GCG CTA ACA GCC GTA
 P   A   N   N   L   P   D   T   Q   S   S   G   P   A   H   S   K   E   T   P   A   L   T   A   V

GAG ACA GGG GCC ACC AAC CCA TTG GTG CCT TCA GAC ACG GTA CAA ACT CGT CAC GTC ATC CAA AAG CGG ACG CGG
                                                                 G
 E   T   G   A   T   N   P   L   V   P   S   D   T   V   Q   T   R   H   V   I   Q   K   R   T   R

TCG GAG TCT ACG GTT GAG TCT TTC TTC GCA AGA GGA GCT TGT GTG GCC ATT ATT GAA GTG GAT AAT GAT GCT CCA
                                         C G
 S   E   S   T   V   E   S   F   F   A   R   G   A   C   V   A   I   I   E   V   D   N   D   A   P

ACA AAG CGT GCC AGT AAA TTA TTT TCA GTC TGG AAG ATA ACT TAC AAA GAC ACC GTT CAG TTA AGA CGT AAG TTG
             G                                                                       C G   G
 T   K   R   A   S   K   L   F   S   V   W   K   I   T   Y   K   D   T   V   Q   L   R   R   K   L

GAG TTC TTT ACA TAT TCA AGG TTT GAC ATG GAG TTC ACC TTT GTG GTT ACA TCC AAT TAT ACC GAT GCA AAC AAT
                         C
 E   F   F   T   Y   S   R   F   D   M   E   F   T   F   V   V   T   S   N   Y   T   D   A   N   N

GGG CAC GCA CTA AAT CAA GTT TAC CAG ATA ATG TAC ATA CCA CCT GGG GCA CCG ATC CCT GGC AAG TGG AAT GAT
 G   H   A   L   N   Q   V   Y   Q   I   M   Y   I   P   P   G   A   P   I   P   G   K   W   N   D

TAC ACA TGG CAA ACG TCA TCT AAC CCA TCA GTG TTT TAC ACT TAC GGG GCA CCT CCA GCT AGA ATA TCA GTG CCC
                                                                                         C G
 Y   T   W   Q   T   S   S   N   P   S   V   F   Y   T   Y   G   A   P   P   A   R   I   S   V   P

TAC GTG GGC ATT GCC AAT GCA TAT TCT CAT TTT TAC GAT GGG TTT GCC AAA GTA CCA CTA GCA GGC CAA GCC TCA
 Y   V   G   I   A   N   A   Y   S   H   F   Y   D   G   F   A   K   V   P   L   A   G   Q   A   S

ACA GAG GGT GAC TCG CTG TAT GGA GCG GCT TCA TTG AAT GAC TTC GGA TCA CTG GCT GTT CGA GTG GTG AAT GAC
                                                                                 G
 T   E   G   D   S   L   Y   G   A   A   S   L   N   D   F   G   S   L   A   V   R   V   V   N   D

CAC AAC CCT ACG AAA CTC ACT TCA AAA ATC AGA GTG TAC ATG AAA CCA AAG CAC GTC AGA GTG TGG TGT CCG CGA
                                         C G                           C G                         G
 H   N   P   T   K   L   T   S   K   I   R   V   Y   M   K   P   K   H   V   R   V   W   C   P   R

CCC CCT CGA GCA GTC CCA TAC TAC GGA CCA GGG GTT GAC TAC AAG GAT GGA CTA GCC CCA CTG CCA GAG AAA GGC
             G
 P   P   R   A   V   P   Y   Y   G   P   G   V   D   Y   K   D   G   L   A   P   L   P   E   K   G

TTG ACA ACC TAT GGT TTT GGC CAC CAA AAT AAG GCA GTG TAC ACG GCA GGT TAC AAA ATT TGC AAT TAC CAC CTC
 L   T   T   Y   G   F   G   H   Q   N   K   A   V   Y   T   A   G   Y   K   I   C   N   Y   H   L

GCC ACC CAG GAA GAC TTA CAA AAT GCG GTA AAC ATT ATG TGG ATT AGA GAC CTT TTA GTA GTG GAA TCC AAA GCC
                                         C G
 A   T   Q   E   D   L   Q   N   A   V   N   I   M   W   I   R   D   L   L   V   V   E   S   K   A

CAA GGC ATA GAC TCA ATT GCT AGA TGT AAC TGC CAC ACT GGA GTG TAC TAC TGT GAA TCC AGG AGG AAG TAC TAC
                                 C G                                                 C       C
 Q   G   I   D   S   I   A   R   C   N   C   H   T   G   V   Y   Y   C   E   S   R   R   K   Y   Y

CCG GTC TCT TTT ACT GGC CCC ACC TTT CAG TAC ATG GAA GCA AAT GAG TAC TAT CCA GCC CGA TAC CAA TCC CAC
                                                                                         G
 P   V   S   F   T   G   P   T   F   Q   Y   M   E   A   N   E   Y   Y   P   A   R   Y   Q   S   H
```

FIG. 9C

```
ATG TTA ATT GGC CAT GGT TTT GCA TCT CCA GGG GAC TGT GGT GGG ATT CTC AGG TGC CAA CAT GGA GTA ATT GGA
                                                                        C
 M   L   I   G   H   G   F   A   S   P   G   D   C   G   G   I   L   R   C   Q   H   G   V   I   G

ATC ATT ACA GCT GGA GGA GAA GGC CTA GTC GCT TTC TCG GAC ATC AGA GAT CTG TAC GCA TAC GAG GAG GAG GCT
                                                        C G
 I   I   T   A   G   G   E   G   L   V   A   F   S   D   I   R   D   L   Y   A   Y   E   E   E   A

ATG GAG CAG GGA GTC TCC AAC TAT ATT GAG TCC CTT GGG GCT GCA TTT GGG AGT GGA TTC ACC CAG CAA ATA GGA
 M   E   Q   G   V   S   N   Y   I   E   S   L   G   A   A   F   G   S   G   F   T   Q   Q   I   G

AAC AAA ATT TCA GAA CTC ACT AGC ATG GTC ACC AGC ACT ATA ACT GAG AAA CTA CTA AAG AAT CTC ATT AAA ATA
 N   K   I   S   E   L   T   S   M   V   T   S   T   I   T   E   K   L   L   K   N   L   I   K   I

ATT TCA TCC CTT GTT ATC ATC ACC AGA AAC TAT GAA GAC ACG ACC ACA GTG CTG GCT ACC CTT GCT CTC CTC GGT
                                C G
 I   S   S   L   V   I   I   T   R   N   Y   E   D   T   T   T   V   L   A   T   L   A   L   L   G

TGT GAT GCG TCC CCA TGG CAA TGG CTA AAG AAG AAA GCC TGT GAC ATC TTG GAA ATC CCC TAC ATC ATG CGA CAG
                                                                                            G
 C   D   A   S   P   W   Q   W   L   K   K   K   A   C   D   I   L   E   I   P   Y   I   M   R   Q

GGC GAT AGC TGG TTG AAG AAG TTT ACA GAG GCA TGC AAT GCA GCC AAG GGA TTG GAA TGG GTG TCT AAT AAA ATA
 G   D   S   W   L   K   K   F   T   E   A   C   N   A   A   K   G   L   E   W   V   S   N   K   I

TCC AAA TTT ATT GAC TGG CTC AAA GAG AAG ATC ATT CCA CAG GCT AGA GAC AAG CTA GAG TTT GTT ACC AAA CTG
                                                            C G
 S   K   F   I   D   W   L   K   E   K   I   I   P   Q   A   R   D   K   L   E   F   V   T   K   L

AAG CAA CTA GAA ATG TTG GAG AAC CAA ATT GCA ACC ATT CAT CAA TCG TGC CCA AGT CAG GAG CAT CAA GAA ATC
 K   Q   L   E   M   L   E   N   Q   I   A   T   I   H   Q   S   C   P   S   Q   E   H   Q   E   I

CTG TTC AAT AAC GTG AGA TGG TTA TCC ATA CAG TCA AAG AGA TTT GCC CCG CTC TAT GCG GTT GAG GCT AAG AGA
                    C G                         C G                                             C G
 L   F   N   N   V   R   W   L   S   I   Q   S   K   R   F   A   P   L   Y   A   V   E   A   K   R

ATA CAA AAG TTA GAG CAC ACG ATT AAC AAC TAC GTA CAG TTC AAG AGC AAA CAC CGT ATT GAA CCA GTA TGT TTG
 I   Q   K   L   E   H   T   I   N   N   Y   V   Q   F   K   S   K   H   R   I   E   P   V   C   L

TTG GTG CAC GGT AGC CCA GGC ACG GGC AAG TCA GTT GCC ACC AAT TTA ATT GCC AGA GCA ATA GCA GAG AAG GAG
                                                                            C G
 L   V   H   G   S   P   G   T   G   K   S   V   A   T   N   L   I   A   R   A   I   A   E   K   E

AAC ACC TCC ACA TAC TCA CTA CCA CCA GAT CCC TCC CAT TTC GAT GGG TAC AAG CAA CAA GGT GTG GTG ATC ATG
 N   T   S   T   Y   S   L   P   P   D   P   S   H   F   D   G   Y   K   Q   Q   G   V   V   I   M

GAT GAT TTG AAT CAG AAC CCA GAC GGA GCA GAC ATG AAG CTG TTT TGT CAG ATG GTC TCC ACT GTA GAA TTC ATA
 D   D   L   N   Q   N   P   D   G   A   D   M   K   L   F   C   Q   M   V   S   T   V   E   F   I

CCA CCA ATG GCT TCG CTA GAA GAA AAG GGT ATT TTG TTC ACA TCT AAT TAC GTT TTG GCC TCA ACC AAT TCC AGT
 P   P   M   A   S   L   E   E   K   G   I   L   F   T   S   N   Y   V   L   A   S   T   N   S   S

CGC ATC ACC CCA CCA ACT GTT GCG CAC AGC GAT GCC CTA GCC AGG CGC TTT GCA TTT GAC ATG GAC ATA CAA ATC
 G                                                          C   G
 R   I   T   P   P   T   V   A   H   S   D   A   L   A   R   R   F   A   F   D   M   D   I   Q   I

ATG AGC GAG TAT TCT AGA GAT GGA AAA TTG AAC ATG GCG ATG GCA ACT GAA ATG TGT AAG AAC TGT CAT CAA CCA
                    C G
 M   S   E   Y   S   R   D   G   K   L   N   M   A   M   A   T   E   M   C   K   N   C   H   Q   P

GCA AAC TTC AAG AGA TGT TGC CCA TTG GTG TGT GGC AAA GCC ATC CAG CTG ATG GAC AAA TCT TCC AGA GTC AGA
                C G                                                                     C G     C G
 A   N   F   K   R   C   C   P   L   V   C   G   K   A   I   Q   L   M   D   K   S   S   R   V   R

TAT AGT ATA GAT CAG ATT ACT ACC ATG ATT ATT AAT GAG AGG AAC AGA AGA TCA AGT ATC GGT AAT TGC ATG GAG
                                                    C       C G C G
 Y   S   I   D   Q   I   T   T   M   I   I   N   E   R   N   R   R   S   S   I   G   N   C   M   E

GCA CTT TTC CAA GGT CCT CTT CAA TAC AAA GAC CTG AAA ATA GAC ATT AAG ACC ACA CCT CCT CCT GAG TGC ATC
 A   L   F   Q   G   P   L   Q   Y   K   D   L   K   I   D   I   K   T   T   P   P   P   E   C   I

AAT GAT TTG CTC CAA GCA GTT GAT TCT CAA GAG GTA AGA GAC TAC TGT GAG AAG AAG GGT TGG ATA GTA GAC ATC
                                                    C G
 N   D   L   L   Q   A   V   D   S   Q   E   V   R   D   Y   C   E   K   K   G   W   I   V   D   I
```

FIG. 9D

```
ACT AGT CAG GTG CAA ACC GAA AGA AAC ATC AAT AGA GCA ATG ACT ATT CTT CAG GCG GTC ACC ACA TTT GCC GCA
                         C G             C G
 T   S   Q   V   Q   T   E   R   N   I   N   R   A   M   T   I   L   Q   A   V   T   T   F   A   A

GTT GCT GGA GTG GTG TAT GTG ATG TAC AAA CTC TTT GCA GGG CAT CAA GGA GCG TAT ACA GGG CTT CCC AAT AAG
 V   A   G   V   V   Y   V   M   Y   K   L   F   A   G   H   Q   G   A   Y   T   G   L   P   N   K

AGA CCC AAT GTC CCC ACC ATC AGG ACT GCC AAG GTT CAG GGC CCA GGA TTT GAC TAC GCA GTG GCA ATG GCC AAA
C G                             C
 R   P   N   V   P   T   I   R   T   A   K   V   Q   G   P   G   F   D   Y   A   V   A   M   A   K

AGA AAC ATT CTT ACG GCA ACT ACC ATT AAG GGA GAG TTC ACA ATG CTC GGA GTG CAT GAT AAT GTG GCC ATT CTA
C G
 R   N   I   L   T   A   T   T   I   K   G   E   F   T   M   L   G   V   H   D   N   V   A   I   L

CCA ACC CAC GCA TCA CCG GGT GAA ACA ATA GTC ATT GAT GGC AAG GAA GTA GAG GTA CTG GAT GCT AAA GCC CTG
 P   T   H   A   S   P   G   E   T   I   V   I   D   G   K   E   V   E   V   L   D   A   K   A   L

GAG GAC CAG GCC GGG ACC AAC CTA GAA ATC ACC ATT GTC ACT CTT AAG AGA AAT GAG AAG TTC AGG GAC ATC AGA
                                                                C G                         C G
 E   D   Q   A   G   T   N   L   E   I   T   I   V   T   L   K   R   N   E   K   F   R   D   I   R

CCA CAC ATC CCC ACT CAA ATC ACT GAG ACA AAT GAT GGA GTT TTA ATT GTG AAC ACT AGT AAG TAC CCC AAC ATG
 P   H   I   P   T   Q   I   T   E   T   N   D   G   V   L   I   V   N   T   S   K   Y   P   N   M

TAT GTT CCT GTC GGT GCT GTG ACT GAA CAG GGG TAT CTC AAT CTC GGT GGA CGC CAA ACT GCT CGT ACT TTA ATG
                                                                     G                  G
 Y   V   P   V   G   A   V   T   E   Q   G   Y   L   N   L   G   G   R   Q   T   A   R   T   L   M

TAC AAC TTT CCA ACG AGA GCA GGT CAA TGT GGT GGA GTT ATC ACC TGC ACT GGC AAG GTC ATC GGG ATG CAT GTT
                 C G
 Y   N   F   P   T   R   A   G   Q   C   G   G   V   I   T   C   T   G   K   V   I   G   M   H   V

GGT GGG AAC GGT TCA CAT GGG TTC GCA GCA GCC CTG AAG CGA TCC TAT TTC ACT CAG AGT CAA GGT GAA ATC CAG
                                                         G
 G   G   N   G   S   H   G   F   A   A   A   L   K   R   S   Y   F   T   Q   S   Q   G   E   I   Q

TGG ATG AGA CCA TCA AAA GAA GTG GGC TAC CCC GTT ATT AAT GCT CCA TCT AAA ACT AAA CTG GAA CCC AGT GCA
         C G
 W   M   R   P   S   K   E   V   G   Y   P   V   I   N   A   P   S   K   T   K   L   E   P   S   A

TTC CAT TAT GTG TTT GAA GGT GTC AAG GAA CCA GCT GTG CTC ACC AAA AGT GAC CCC AGA TTG AAG ACA GAT TTT
                                                                                     C G
 F   H   Y   V   F   E   G   V   K   E   P   A   V   L   T   K   S   D   P   R   L   K   T   D   F

GAA GAG GCT ATC TTT TCC AAG TAT GTG GGA AAT AAG ATT ACT GAA GTG GAT GAG TAC ATG AAA GAA GCT GTC GAT
 E   E   A   I   F   S   K   Y   V   G   N   K   I   T   E   V   D   E   Y   M   K   E   A   V   D

CAT TAC GCA GGC CAG CTC ATG TCA CTA GAC ATC AAC ACA GAA CAA ATG TGC CTT GAG GAT GCA ATG TAT GGC ACT
 H   Y   A   G   Q   L   M   S   L   D   I   N   T   E   Q   M   C   L   E   D   A   M   Y   G   T

GAC GGT CTC GAA GCT CTA GAC CTC AGT ACC AGT GCT GGG TAT CCC TAT GTG GCA ATG GGA AAA AAG AAA AGA GAC
                                                                                             C G
 D   G   L   E   A   L   D   L   S   T   S   A   G   Y   P   Y   V   A   M   G   K   K   K   R   D

ATT TTG AAT AAG CAA ACC AGA GAC ACA AAG GAA ATG CAA AGG CTT CTG GAC ACC TAT GGT ATT AAT TTA CCT TTA
                         C G                             C
 I   L   N   K   Q   T   R   D   T   K   E   M   Q   R   L   L   D   T   Y   G   I   N   L   P   L

GTC ACC TAT GTG AAA GAT GAG CTT AGA TCC AAG ACC AAA GTG GAA CAG GGC AAG TCC AGG CTA ATT GAG GCC TCA
                                 C G                                     C
 V   T   Y   V   K   D   E   L   R   S   K   T   K   V   E   Q   G   K   S   R   L   I   E   A   S

AGT CTC AAT GAC TCT GTC GCC ATG AGG ATG GCT TTT GGC AAC TTG TAC GCA GCA TTC CAC AAG AAC CCA GGT GTA
                                 C
 S   L   N   D   S   V   A   M   R   M   A   F   G   N   L   Y   A   A   F   H   K   N   P   G   V

GTG ACA GGA TCG GCT GTT GGC TGT GAC CCA GAT TTG TTT TGG AGT AAA ATA CCA GTC CTC ATG GAG GAA AAA CTC
 V   T   G   S   A   V   G   C   D   P   D   L   F   W   S   K   I   P   V   L   M   E   E   K   L

TTT GCA TTT GAT TAC ACG GGT TAT GAT GCT TCA CTA AGC CCC GCC TGG TTT GAG GCT CTC AAG ATG GTT CTA GAG
 F   A   F   D   Y   T   G   Y   D   A   S   L   S   P   A   W   F   E   A   L   K   M   V   L   E

AAA ATT GGG TTT GGT GAC AGA GTG GAT TAC ATT GAT TAT CTG AAT CAC TCG CAC CAT CTA TAT AAA AAT AAG ACA
                         C G
 K   I   G   F   G   D   R   V   D   Y   I   D   Y   L   N   H   S   H   H   L   Y   K   N   K   T
```

FIG. 9E

```
TAT TGT GTT AAG GGC GGC ATG CCA TCT GGC TGC TCT GGC ACC TCA ATT TTT AAT TCA ATG ATT AAT AAT CTA ATA
 Y   C   V   K   G   G   M   P   S   G   C   S   G   T   S   I   F   N   S   M   I   N   N   L   I
ATC AGG ACT CTC TTA CTG AAA ACC TAC AAG GGC ATA GAT TTA GAC CAC CTG AAG ATG ATA GCC TAT GGT GAT GAT
         C
 I   R   T   L   L   L   K   T   Y   K   G   I   D   L   D   H   L   K   M   I   A   Y   G   D   D
GTA ATT GCT TCC TAC CCC CAT GAG GTT GAT GCT AGT CTC CTA GCC CAA TCA GGA AAA GAC TAT GGA CTA ACC ATG
 V   I   A   S   Y   P   H   E   V   D   A   S   L   L   A   Q   S   G   K   D   Y   G   L   T   M
ACA CCA GCT GAC AAA TCA GCC ACC TTT GAA ACA GTC ACA TGG GAG AAT GTA ACA TTC TTG AAA AGA TTC TTT AGA
                                                                                C G           C G
 T   P   A   D   K   S   A   T   F   E   T   V   T   W   E   N   V   T   F   L   R   F   F   R
GCA GAT GAA AAG TAT CCC TTT CTG GTA CAT CCA GTG ATG CCA ATG AAA GAA ATT CAC GAA TCA ATT AGA TGG ACT
                                                                                        C G
 A   D   E   K   Y   P   F   L   V   H   P   V   M   P   M   K   E   I   H   E   S   I   R   W   T
AAA GAT CCC AGA AAC ACT CAG GAT CAT GTT CGC TCA CTG TGC TTA TTG GCT TGG CAC AAT GGC GAG GAA GAG TAC
         C G                               G
 K   D   P   R   N   T   Q   D   H   V   R   S   L   C   L   L   A   W   H   N   G   E   E   E   Y
AAT AAA TTT TTA GCT AAG ATT AGA AGT GTG CCA ATC GGA AGA GCA TTA CTG CTC CCT GAG TAC TCC ACA TTG TAC
                         C G                       C G
 N   K   F   L   A   K   I   R   S   V   P   I   G   R   A   L   L   L   P   E   Y   S   T   L   Y
CGC CGT TGG CTC GAC TCA TTT
  G   G                  ;
 R   R   W   L   D   S   F  ?368
```

FIG. 10A
Foot-and Mouth Disease Virus, serotype O, strain UKG/35/2001, complete capsid,
codons for 9 amino acids modified
GenBank AJ539141 1695-3896, 2202 nt, 734 aa

```
GGC GCC GGG CAA TCC AGC CCG GCG ACT GGG TCA CAG AAC CAG TCA GGC AAC ACT GGA AGC ATT ATC AAC AAT TAC
 G   G                       G             G           G  G        G  G        A  A
 G   A   G   Q   S   S   P   A   T   G   S   Q   N   Q   S   G   N   T   G   S   I   I   N   N   Y

TAC ATG CAG CAG TAC CAG AAC TCC ATG GAC ACG CAG CTT GGT GAC AAC GCT ATT AGC GGA GGC TCC AAC GAG GGG
                         G                              A  G        G  A        G  G  G
 Y   M   Q   Q   Y   Q   N   S   M   D   T   Q   L   G   D   N   A   I   S   G   G   S   N   E   G

TCC ACG GAC ACC ACC TCC ACT CAC ACA ACC AAC ACT CAG AAC AAT GAC TGG TTT TCA AAG CTG GCC AGT TCC GCT
     G           G  G  G        G  G        G                                G     A  TCG  G  G
 S   T   D   T   T   S   T   H   T   T   N   T   Q   N   N   D   W   F   S   K   L   A   S   S   A

TTT AGC GGT CTT TTC GGC GCT CTT CTT GCT GAC AAG AAA ACC GAG GAG ACC ACT CTT CTC GAG GAC CGC ATC CTC
         G  A       G   G  A   G                     G              G   G  A            A  A   A
 F   S   G   L   F   G   A   L   L   A   D   K   K   T   E   E   T   L   L   E   D   R   I   L

ACT ACC CGC AAC GGA CAC ACG ACC TCG ACA ACC CAG TCG AGC GTT GGA GTC ACT TAC GGG TAC GCA ACA GCT GAG
     G  A       G           G       G  G           A  G  A  G              G  G  G
 T   T   R   N   G   H   T   T   S   T   T   Q   S   S   V   G   V   T   Y   G   Y   A   T   A   E

GAC TTT GTG AGC GGA CCA AAC ACA TCT GGG CTT GAG ACC AGG GTT GTG CAG GCA GAG CGG TTC TTC AAA ACC CAC
             A      G  G       G  G           A        G  C  A  A        G        A                 G
 D   F   V   S   G   P   N   T   S   G   L   E   T   R   V   V   Q   A   E   R   F   F   K   T   H

TTG TTC GAC TGG GTC ACC AGT GAC CCG TTT GGA CGG TGC TAT CTG CTG GAA CTC CCA ACT GAC CAC AAA GGT GTC
 C  A               A   G  TCG          G  A           A  A         A  G  G                     G  A
 L   F   D   W   V   T   S   D   P   F   G   R   C   Y   L   L   E   L   P   T   D   H   K   G   V

TAC GGC AGC CTG ACC GAC TCT TAT GCT TAC ATG AGA AAC GGT TGG GAT GTT GAG GTC ACC GCA GTG GGA AAT CAG
         G  A       G        G          G                C       G           A        A  G  A  G
 Y   G   S   L   T   D   S   Y   A   Y   M   R   N   G   W   D   V   E   V   T   A   V   G   N   Q

TTC AAC GGA GGA TGT CTG TTG GTG GCC ATG GTG CCA GAA CTT TGC TCT ATT GAC AAG AGA GAG CTG TAC CAG CTC
         G   G      A  C  A  G          A  G        A  G      G  A         C        A              A
 F   N   G   G   C   L   L   V   A   M   V   P   E   L   C   S   I   D   K   R   E   L   Y   Q   L

ACG CTC TTT CCC CAC CAG TTC ATC AAC CCC CGG ACG AAC ATG ACG GCG CAC ATC ACT GTG CCC TTT GTT GGC GTC
     A       G                  A       G  A                            A  G  A  G          A  G  A
 T   L   F   P   H   Q   F   I   N   P   R   T   N   M   T   A   H   I   T   V   P   F   V   G   V

AAC CGC TAC GAC CAG TAC AAG GTA CAC AAA CCT TGG ACC CTC GTG GTT ATG GTT GTG GCC CCG CTG ACT GTC AAC
     A                              G       G  A  A              A  A              A  G        A
 N   R   Y   D   Q   Y   K   V   H   K   P   W   T   L   V   V   M   V   V   A   P   L   T   V   N

ACC GAA GGT GCC CCA CAG ATC AAG GTC TAT GCC AAC ATC GCC CCT ACC AAC GTG CAC GTT GCG GGT GAG TTC CCT
 G       G   G          A       A       G       A  G  G   G        A        A  G                    G
 T   E   G   A   P   Q   I   K   V   Y   A   N   I   A   P   T   N   V   H   V   A   G   E   F   P

TCT AAG GAA GGG ATC TTC CCC GTG GCA TGT AGC GAC GGT TAC GGT GGT CTG GTG ACC ACT GAC CCA AAG ACG GCT
         G          A   G  A  G         C              G        G  G  A  G  G     G                 G
 S   K   E   G   I   F   P   V   A   C   S   D   G   Y   G   G   L   V   T   T   D   F   K   T   A

GAC CCC GCC TAC GGG AAA GTG TTC AAT CCA CCT CGC AAC ATG TTG CCG GGG CGG TTC ACC AAC TTC CTT GAT GTG
 G   G              A           G  G  A       C  A              A  G        A                    A  A
 D   P   A   Y   G   K   V   F   N   P   P   R   N   M   L   P   G   R   F   T   N   F   L   D   V

GCT GAG GCG TGC CCT ACG TTT CTG CAC TTT GAG GGT GGC GTG CCG TAC GTG ACC ACA AAG ACG GAC TCA GAC AGG
 G                                           G  G  A             A  G  G  A                     C  A
 A   E   A   C   P   T   F   L   H   F   E   G   V   P   Y   V   T   T   K   T   D   S   D   R

GTG CTC GCC CAG TTC GAC TTG TCT CTG GCA GCA AAG CAC ATG TCA AAC ACC TTC CTG GCA GGT CTC GCC CAG TAC
 A  A   G           C  A  G  A  G                            G           G  A  G  G  A  G
 V   L   A   Q   F   D   L   S   L   A   A   K   H   M   S   N   T   F   L   A   G   L   A   Q   Y

TAC ACA CAG TAC AGC GGC ACC ATC AAC CTG CAC TTC ATG TTC ACA GGA CCC ACT GAC GCG AAA GCG CGT TAC ATG
         G          G  G  A       A                        G  G  G  G                    A
 Y   T   Q   Y   S   G   T   I   N   L   H   F   M   F   T   G   P   T   D   A   K   R   Y   M

ATT GCA TAC GCC CCC CCT GGT ATG GAG CCG CCC AAA ACA CCT GAG GCG GCC GCC CAC TGC ATT CAT GCG GAG TGG
 A   G       G   G   G                       G       G   G              G  G         A
 I   A   Y   A   P   P   G   M   E   P   P   K   T   P   E   A   A   A   H   C   I   H   A   E   W

GAC ACA GGG TTG AAT TCA AAA TTC ACA TTT TCA ATC CCT TAC CTT TCG GCG GCT GAT TAC GCG TAC ACC GCG TCT
         G   C  A       G             G  A  G       A                G                     G       G
 D   T   G   L   N   S   K   F   T   F   S   I   P   Y   L   S   A   A   D   Y   A   Y   T   A   S
```

FIG. 10B

```
GAC GCT GCG GAG ACC ACA AAT GTA CAG GGA TGG GTT TGC CTG TTT CAA ATT ACA CAC GGG AAG GCT GAC GGC GAC
      G           G   G               G       A       A           A G               G           G
 D    A   A   E   T   T   N   V   Q   G   W   V   C   L   F   Q   I   T   H   G   K   A   D   G   D

GCA CTG GTC GTT CTA GCT AGC GCC GGT AAG GAC TTT GAG CTG CGT CTG CCA GTT GAC GCT CGC ACG CAG ACC ACC
  G   A   A   A       G       G   G                       A   A   A   G       G   A           G   G
 A    L   V   V   L   A   S   A   G   K   D   F   E   L   R   L   P   V   D   A   R   T   Q   T   T

TCC GCA GGT GAG TCG GCT GAC CCC GTG ACT GCC ACT GTT GAG AAC TAC GGT GGT GAG ACA CAG GTC CAG AGA CGC
  G   G   G           G       G       A   G   G   A                   G   G       G       A   C   A
 S    A   G   E   S   A   D   P   V   T   A   T   V   E   N   Y   G   G   E   T   Q   V   Q   R   R

CAA CAC ACG GAT GTC TCG TTC ATA TTA GAC AGA TTT GTG AAA GTA ACA CCA AAA GAC CAA ATT AAT GTG TTG GAC
              A           C       C       A               G   G               A       A C A
 Q    H   T   D   V   S   F   I   L   D   R   F   V   K   V   T   P   K   D   Q   I   N   V   L   D

CTG ATG CAA ACC CCT GCA CAC ACT TTG GTA GGC GCG CTC CTC CGT ACT GCC ACC TAC TAC TTC GCA GAT CTA GAA
  A           G   G           G C A       G           A   A   A G G                   G
 L    M   Q   T   P   A   H   T   L   V   G   A   L   L   R   T   A   T   Y   Y   F   A   D   L   E

GTG GCA GTG AAA CAC GAG GGG AAC CTT ACC TGG GTC CCG AAT GGG GCG CCC GAG ACA GCG TTG GAC AAC ACC ACC
  A   G   A               A       G       A               C A           G               G       G
 V    A   V   K   H   E   G   N   L   T   W   V   P   N   G   A   P   E   T   A   L   D   N   T   T

AAT CCA ACG GCT TAC CAC AAG GCA CCG CTC ACC CGG CTT GCA CTG CCT TAC ACG GCA CCG CAC CGT GTC TTG GCT
      G   G                   G       A   G   A   A G                   G                   A C A G
 N    P   T   A   Y   H   K   A   P   L   T   R   L   A   L   P   Y   T   A   P   H   R   V   L   A

ACT GTT TAC AAC GGG AAC TGC AAG TAT GGC GAG AGC CCC GTG ACC AAT GTG AGA GGT GAC CTG CAA GTA TTG GCC
  G   A                           G           G   A   G       A C   G       A               C A   G
 T    V   Y   N   G   N   C   K   Y   G   E   S   P   V   T   N   V   R   G   D   L   Q   V   L   A

CAA AAG GCG GCA AGA ACG CTG CCT ACC TCC TTC AAT TAC GGT GCC ATC AAA GCC ACT CGG GTG ACT GAA CTG CTT
          G C       A   G   G                           G   A       G   G   A   A   G       A   A
 Q    K   A   A   R   T   L   P   T   S   F   N   Y   G   A   I   K   A   T   R   V   T   E   L   L

TAC CGC ATG AAG AGG GCC GAA ACA TAC TGC CCC CGG CCT CTT TTG GCT ATT CAC CCA AGC GAA GCT AGA CAC AAA
      A           C   A   G           G           G   A   G   A   C   A       G               G C
 Y    R   M   K   R   A   E   T   Y   C   P   R   P   L   L   A   I   H   P   S   E   A   R   H   K

CAA AAG ATT GTT GCG CCT GTG AAA CAG
          A   A       G   A
 Q    K   I   V   A   P   V   K   Q
```

FIG. 11A
SARS coronavirus, strain Urbani, GenBank AY278741
S (spike) glycoprotein, nt 21,492-25,256

```
21,492
|
ATG TTT ATT TTC TTA TTA TTT CTT ACT CTC ACT AGT GGT AGT GAC CTT GAC CGG TGC ACC ACT TTT GAT GAT GTT
      C     C G C G       G       G   G TCG   G TCG       G                 G   G                 C
 M   F   I   F   L   L   F   L   T   L   T   S   G   S   D   L   D   R   C   T   T   F   D   D   V

CAA GCT CCT AAT TAC ACT CAA CAT ACT TCA TCT ATG AGG GGG GTT TAC TAT CCT GAT GAA ATT TTT AGA TCA GAC
    G   G               G   G   G   G               G                   C           C G G
 Q   A   P   N   Y   T   Q   H   T   S   S   M   R   G   V   Y   Y   P   D   E   I   F   R   S   D

ACT CTT TAT TTA ACT CAG GAT TTA TTT CTT CCA TTT TAT TCT AAT GTT ACA GGG TTT CAT ACT ATT AAT CAT ACG
    G   G       C G G           C G         G G         G       C G                     G C
 T   L   Y   L   T   Q   D   L   F   L   P   F   Y   S   N   V   T   G   F   H   T   I   N   H   T

TTT GGC AAC CCT GTC ATA CCT TTT AAG GAT GGT ATT TAT TTT GCT GCC ACA GAG AAA TCA AAT GTT GTC CGT GGT
    G       G           C G                     G C         G G G           G       C           G G
 F   G   N   P   V   I   P   F   K   D   G   I   Y   F   A   A   T   E   K   S   N   V   V   R   G

TGG GTT TTT GGT TCT ACC ATG AAC AAC AAG TCA CAG TCG GTG ATT ATT ATT AAC AAT TCT ACT AAT GTT GTT ATA
    C           G   G G                     G           C   C   C           G   G           C   C C
 W   V   F   G   S   T   M   N   N   K   S   Q   S   V   I   I   I   N   N   S   T   N   V   V   I

CGA GCA TGT AAC TTT GAA TTG TGT GAC AAC CCT TTC TTT GCT GTT TCT AAA CCC ATG GGT ACA CAG ACA CAT ACT
 G G             C                   G             G C G   G       G       G       G       G
 R   A   C   N   F   E   L   C   D   N   P   F   F   A   V   S   K   P   M   G   T   Q   T   H   T

ATG ATA TTC GAT AAT GCA TTT AAT TGC ACT TTC GAG TAC ATA TCT GAT GCC TTT TCG CTT GAT GTT TCA GAA AAG
        C               G               G           C G     G               G       C G
 M   I   F   D   N   A   F   N   C   T   F   E   Y   I   S   D   A   F   S   L   D   V   S   E   K

TCA GGT AAT TTT AAA CAC TTA CGA GAG TTT GTG TTT AAA AAT AAA GAT GGG TTT CTC TAT GTT TAT AAG GGC TAT
    G G         C G G           C                                                               G
 S   G   N   F   K   H   L   R   E   F   V   F   K   N   K   D   G   F   L   Y   V   Y   K   G   Y

CAA CCT ATA GAT GTA GTT CGT GAT CTA CCT TCT GGT TTT AAC ACT TTG AAA CCT ATT TTT AAG TTG CCT CTT GGT
        G   C                   G   G G G                   G   G C                 C     G G G
 Q   P   I   D   V   V   R   D   L   P   S   G   F   N   T   L   K   P   I   F   K   L   P   L   G

ATT AAC ATT ACA AAT TTT AGA GCC ATT CTT ACA GCC TTT TCA CCT GCT CAA GAC ATT TGG GGC ACG TCA GCT GCA
 C       C G         C G     C G   C G G           G G G               C       G           G G G
 I   N   I   T   N   F   R   A   I   L   T   A   F   S   P   A   Q   D   I   W   G   T   S   A   A

GCC TAT TTT GTT GGC TAT TTA AAG CCA ACT ACA TTT ATG CTC AAG TAT GAT GAA AAT GGT ACA ATC ACA GAT GCT
 G           C   G       C G         G G G         G                     G   G       G       G
 A   Y   F   V   G   Y   L   K   P   T   T   F   M   L   K   Y   D   E   N   G   T   I   T   D   A

GTT GAT TGT TCT CAA AAT CCA CTT GCT GAA CTC AAA TGC TCT GTT AAG AGC TTT GAG ATT GAC AAA GGA ATT TAC
 C           G           G G G       G             G C     TCG             C                 G C
 V   D   C   S   Q   N   P   L   A   E   L   K   C   S   V   K   S   F   E   I   D   K   G   I   Y

CAG ACC TCT AAT TTC AGG GTT GTT CCC TCA GGA GAT GTT GTG AGA TTC CCT AAT ATT ACA AAC TTG TGT CCT TTT
    G G         C   C   C   G G       C   C C G         G       C G     C
 Q   T   S   N   F   R   V   V   P   S   G   D   V   V   R   F   P   N   I   T   N   L   C   P   F

GGA GAG GTT TTT AAT GCT ACT AAA TTC CCT TCT GTC TAT GCA TGG GAG AGA AAA AAA ATT TCT AAT TGT GTT GCT
        G   C               G G         G G         G           C G           C G           C     G
 G   E   V   F   N   A   T   K   F   P   S   V   Y   A   W   E   R   K   K   I   S   N   C   V   A

GAT TAC TCT GTG CTC TAC AAC TCA ACA TTT TTT TCA ACC TTT AAG TGC TAT GGC GTT TCT GCC ACT AAG TTG AAT
        G   C               G G         G G                             G C G           G
 D   Y   S   V   L   Y   N   S   T   F   F   S   T   F   K   C   Y   G   V   S   A   T   K   L   N

GAT CTT TGC TTC TCC AAT GTC TAT GCA GAT TCT TTT GTA GTC AAG GGA GAT GAT GTA AGA CAA ATA GCG CCA GGA
        G           G           G       G                   G                   C C G     C
 D   L   C   F   S   N   V   Y   A   D   S   F   V   V   K   G   D   D   V   R   Q   I   A   P   G

CAA ACT GGT GTT ATT GCT GAT TAT AAT TAT AAA TTG CCA GAT GAT TTC ATG GGT TGT GTC CTT GCT TGG AAT ACT
        G   G   C   C G                         C   G             G                   G G         G
 Q   T   G   V   I   A   D   Y   N   Y   K   L   P   D   D   F   M   G   C   V   L   A   W   N   T

AGG AAC ATT GAT GCT ACT TCA ACT GGT AAT TAT AAT TAT AAA TAT AGG TAT CTT AGA CAT GGC AAG CTT AGG CCC
 C       C       G   G   G G G                                   C         G C G     G   G C     G
 R   N   I   D   A   T   S   T   G   N   Y   N   Y   K   Y   R   Y   L   R   H   G   K   L   R   P

TTT GAG AGA GAC ATA TCT AAT GTG CCT TTC TCC CCT GAT GGC AAA CCT TGC ACC CCA CCT GCT CTT AAT TGT TAT
        C G         C G         C G             G           G               G   G G G G
 F   E   R   D   I   S   N   V   P   F   S   P   D   G   K   P   C   T   P   P   A   L   N   C   Y

TGG CCA TTA AAT GAT TAT GGT TTT TAC ACC ACT ACT GGC ATT GGC TAC CAA CCT TAC AGA GTT GTA GTA CTT TCT
    G C G                   G               G G         C G         G                 C G C     G G
 W   P   L   N   D   Y   G   F   Y   T   T   T   G   I   G   Y   Q   P   Y   R   V   V   V   L   S
```

```
GGA AAG GGC TAC CAC CTT ATG TCC TTC CCA CAA GCA GCC CCG CAT GGT GTT GTC TTC CTA CAT GTC ACG TAT GTG
    G           G       G       G       G G       G C           G                               C
 G   K   G   Y   H   L   M   S   F   P   Q   A   A   P   H   G   V   V   F   L   H   V   T   Y   V

CCA TCC CAG GAG AGG AAC TTC ACC ACA GCG CCA GCA ATT TGT CAT GAA GGC AAA GCA TAC TTC CCT CGT GAA GGT
G   G           C               G G       G G       C               G       G           G G       G
 P   S   Q   E   R   N   F   T   T   A   P   A   I   C   H   E   G   K   A   Y   F   P   R   E   G

GTT TTT GTG TTT AAT GGC ACT TCT TGG TTT ATT ACA CAG AGG AAC TTC TTT TCT CCA CAA ATA ATT ACT ACA GAC
    C   C           G   G   G           C   G   C                       G   G       C   C   G
 V   F   V   F   N   G   T   S   W   F   I   T   Q   R   N   F   F   S   P   Q   I   I   T   T   D

AAT ACA TTT GTC TCA GGA AAT TGT GAT GTC GTT ATT GGC ATC ATT AAC AAC ACA GTT TAT GAT CCT CTG CAA CCT
    G           G   G               C   C   G       C               G   C           G               G
 N   T   F   V   S   G   N   C   D   V   V   I   G   I   I   N   N   T   V   Y   D   P   L   Q   P

GAG CTC GAC TCA TTC AAA GAA GAG CTG GAC AAG TAC TTC AAA AAT CAT ACA TCA CCA GAT GTT GAT CTT GGC GAC
    G       G                                                       G   G       C       G   G
 E   L   D   S   F   K   E   E   L   D   K   Y   F   K   N   H   T   S   P   D   V   D   L   G   D

ATT TCA GGC ATT AAC GCT TCT GTC GTC AAC ATT CAA AAA GAA ATT GAC CGC CTC AAT GAG GTC GCT AAA AAT TTA
    C   G   G   C       G   G                               C           G           G               C G
 I   S   G   I   N   A   S   V   V   N   I   Q   K   E   I   D   R   L   N   E   V   A   K   N   L

AAT GAA TCA CTC ATT GAC CTT CAA GAA TTG GGA AAA TAT GAG CAA TAT ATT AAA TGG CCT TGG TAT GTT TGG CTC
            G   G C       G           C   G                               C           G           C   G
 N   E   S   L   I   D   L   Q   E   L   G   K   Y   E   Q   Y   I   K   W   P   W   Y   V   W   L

GGC TTC ATT GCT GGA CTA ATT GCC ATC GTC ATG GTT ACA ATC TTG CTT TGT TGC ATG ACT AGT TGT TGC AGT TGC
 G       C   G   G   C   G           C   G   C   G                               G TCG           TCG
 G   F   I   A   G   L   I   A   I   V   M   V   T   I   L   L   C   C   M   T   S   C   C   S   C

CTC AAG GGT GCA TGC TCT TGT GGT TCT TGC TGC AAG TTT GAT GAG GAT GAC TCT GAG CCA GTT CTC AAG GGT GTC
    G       G       G       G   G   G                                       G       G C   G       G
 L   K   G   A   C   S   C   G   S   C   C   K   F   D   E   D   D   S   E   P   V   L   K   G   V

AAA TTA CAT TAC ACA TAA
    C G           G
 K   L   H   Y   T | stop
                   |
                   25,256
```

FIG. 12A

```
CAAT GGG AGC TAT CGG ACC TCG CTT AGG ACT CCT ATT CCC ATG GAG AGA CTC CTA GAT GAG GTT CTT GCC CCC GGT
                                                      TAT           ATA A  A  A
                                              M   E   R   L   L   D   E   V   L   A   P   G

GGG CCT TAT AAC TTA ACC GTC GGC AGT TGG GTA AGA GAC CAC GTC CGC TCA ATT GTC GAG GGC GCG TGG GAA GTG
  A   A               A   A   ATCA               AAA           A       A  A           A
  G   P   Y   N   L   T   V   G   S   W   V   R   D   H   V   R   S   I   V   E   G   A   W   E   V

CGC GAT GTT GTT TCC GCT GCC CAA AAG CGG GCC ATC GTA GCC GTG ATA CCC AGA CCT GTG TTC ACG CAG ATG CAG
 AA      A   A   A   A   A           A   A   A           A   A       A       A   A       A
  R   D   V   V   S   A   A   Q   K   R   A   I   V   A   V   I   P   R   P   V   F   T   Q   M   Q

GTC AGT GAT CAC CCA GCA CTC CAC GCA ATT TCG CGG TAT ACC CGC CGC CAT TGG ATC GAG TGG GGC CCT AAA GAA
  A   TCA               T  A           AAA       AAAAA                                 A   A
  V   S   D   H   P   A   L   H   A   I   S   R   Y   T   R   R   H   W   I   E   W   G   P   K   E

GCC CTA CAC GTC CTC ATC GAC CCA AGC CCG GGC CTG CTC CGC GAG GTC GCT CGC GTT GAG CGC CGC TGG GTC GCA
     AT       ATA               TCA  A  ATATAAA           A   AAAA  A                       A
  A   L   H   V   L   I   D   P   S   P   G   L   L   R   E   V   A   R   V   E   R   R   W   V   A

CTG TGC CTC CAC AGG ACG GCA CGC AAA CTC GCC ACC GCC CTG GCC GAG ACG GCC AGC GAG GCG TGG CAC GCT GAC
 TA  TTA         A   A   AA       TA  A   A  ATA   A       A   A   TCA       A       A
  L   C   L   H   R   T   A   R   K   L   A   T   A   L   A   E   T   A   S   E   A   W   H   A   D

TAC GTG TGC GCG CTG CGT GGC GCA CCG AGC GGC CCC TTC TAC GTC CAC CCT GAG GAC GTC CCG CAC GGC GGT CGC
     T   A   T   ATAAA  A       ATCA   A   A           T   A           A   A           A   AAA
  Y   V   C   A   L   R   G   A   P   S   G   P   F   Y   V   H   P   E   D   V   P   H   G   G   R

GCC GTG GCG GAC AGA TGC TTG CTC TAC TAC ACA CCC ATG CAG ATG TGC GAG CTG ATG CGT ACC ATT GAC GCC ACC
  A   A   A           T   ATA T  T       A           T   TA   AAA  A                       AA
  A   V   A   D   R   C   L   L   Y   Y   T   P   M   Q   M   C   E   L   M   R   T   I   D   A   T

CTG CTC GTG GCG GTC GAC TTG TGG CCG GTC GCC CTT GCG GCC CAC GTC GGC GAC GAC TGG GAC GAC CTG GGC ATT
 TATA A   A       A       A  ATA  A  A       A   A                                 TA   A
  L   L   V   A   V   D   L   W   P   V   A   L   A   A   H   V   G   D   D   W   D   D   L   G   I

GCC TGG CAT CTC GAC CAT GAC GGC GGT TGC CCC GCC GAT TGC CGC GGA GCC GGC GCT GGG CCC ACG CCC GGC TAC
  A           TA               AA  T  AA        TAA       A   A  AAAAA   AAAT
  A   W   H   L   D   H   D   G   G   C   P   A   D   C   R   G   A   G   A   G   P   T   P   G   Y

ACC CGC CCC TGC ACC ACA CGC ATC TAC CAA GTC CTG CCG GAC ACC GCC CAC CCC GGG CGC CTC TAC CGG TGC GGG
     AAA  A       AA         T      ATA  A       A       A   A   AAATA TAA  T  A
  T   R   P   C   T   T   R   I   Y   Q   V   L   P   D   T   A   H   P   G   R   L   Y   R   C   G

CCC CGC CTG TGG ACG CGC GAT TGC GCC GTG GCC GAA CTC TCA TGG GAG GTT GCC CAA CAC TGC GGG CAC CAG GCG
 AAATA        AAA         T  AAA  A       TA                       AA      T  A                 A
  P   R   L   W   T   R   D   C   A   V   A   E   L   S   W   E   V   A   Q   H   C   G   H   Q   A

CGC GTG CGC GCC GTG CGG TGC ACC CTC CCT ATC CGC CAC GTG CGC AGC CTC CAA CCC AGC GCG CGG GTC CGA CTC
 AA   AAA  A    AAA   T ATA  A       AA         AAATCA  T A     ATCA AAA  A   AA        T A
  R   V   R   A   V   R   C   T   L   P   I   R   H   V   R   S   L   Q   P   S   A   R   V   R   L

CCG GAC CTC GTC CAT CTC GCC GAG GTG GGC CGG TGG CGG TGG TTC AGC CTC CCC CGC CCC GTG TTC CAG CGC ATG
     A   TA         T  A    A           A   AAA        AA                 TCA TA AAA  A  A       AA
  P   D   L   V   H   L   A   E   V   G   R   W   R   W   F   S   L   P   R   P   V   F   Q   R   M

CTG TCC TAC TGC AAG ACC CTG AGC CCC GAC GCG TAC TAC AGC GAG CGC GTG TTC AAG TTC AAG AAC GCC CTG AGC
 TA  A  T   T       ATA TCA A      A     T  TCA      AA  A                             A   TA TCA
  L   S   Y   C   K   T   L   S   P   D   A   Y   Y   S   E   R   V   F   K   F   K   N   A   L   S

CAC AGC ATC ACG CTC GCG GGC AAT GTG CTG CAA GAG GGG TGG AAG GGC ACG TGC GCC GAG GAA GAC GCG CTG TGC
     TCA        ATA  A   A       ATA             A           A   AATA                       ATA T
  H   S   I   T   L   A   G   N   V   L   Q   E   G   W   K   G   T   C   A   E   E   D   A   L   C

GCA TAC GTA GCC TTC CGC GCC TGG CAG TCT AAC GCC AGG TTG GCC GGG ATT ATG AAA AGC GCG AAG CGC TGC GCC
      T    A       AA  A               A         A   A   AAAA                 TCA A    AA T  A
  A   Y   V   A   F   R   A   W   Q   S   N   A   R   L   A   G   I   M   K   S   A   K   R   C   A

GCC GAC TCT TTG AGC GTG GCC GGC TGG CTG GAC ACC ATT TGG GGC GCC ATT AAG CGG TTC TTC CGC AGC GTG CCC
  A       A    ATCA  A                   TA       A           AA             ATCA A    A
  A   D   S   L   S   V   A   G   W   L   D   T   I   W   G   A   I   K   R   F   F   G   S   V   P

CTC GCC GAG CGC ATG GAG GAG TGG GAA CAG GAC GCC GCG GTC GCC GCC TTC GAC CGC GGC CCC CTC GAG GAC GGC
 TA   A   AA                               A  AAAA A             AA A  ATA                      A
  L   A   E   R   M   E   E   W   E   Q   D   A   A   V   A   A   F   D   R   G   P   L   E   D   G
```

FIG. 12B

```
GGG CGC CAC TTG GAC ACC GTG CAA CCC CCA AAA TCG CCG CCC CGC CCT GAG ATC GCC GCG ACC TGG ATC GTC CAC
    AAA   A         A A       A              AA A AAA A                A A A             A
 G   R   H   L   D   T   V   Q   P   P   K   S   P   P   R   P   E   I   A   A   T   W   I   V   H

GCA GCC AGC GCA GAC CGC CAT TGT GCG TGC GCT CCC CGC TGC GAC GTC CCG CGC GAA CGT CCT TCC GCG CCC GCC
        ATCA           AA         A T AAA   T         A AAA       AA A A AAA A
 A   A   S   A   D   R   H   C   A   C   A   P   R   C   D   V   P   R   E   R   P   S   A   P   A

GGC CCG CCG GAT GAC GAG GCG CTC ATC CCG CCG TGG CTG TTC GCC GAG CAC CGT GCC CTC CGC TGC CGC GAG TGG
    AAA   A             ATA       A   A       TA       A         AA   ATAA A TAA
 G   P   P   D   D   E   A   L   I   P   P   W   L   F   A   E   H   R   A   L   R   C   R   E   W

GAT TTC GAG GTT CTC CGC GCG CGC GCC GAT ACG GCG GCC GCG CCC GCC CCG CTG GCT CCA CGC CCT GCG CGG TAC
            ATAA AAA   A           A A A   A A   A   ATA   A         AA A AAA T
 D   F   E   V   L   R   A   R   A   D   T   A   A   A   P   A   P   L   A   P   R   P   A   R   Y

CCC ACC GTG CTC TAC CGC CAC CCC GCC CAC CAC GGT CCG TGG CTC ACC CTT GAC GAG CCG GGC GAG GCT GAC GCG
    A   A   ATA   TAA           A A             A A   TA   ATA           A A           A       A
 P   T   V   L   Y   R   H   P   A   H   H   G   P   W   L   T   L   D   E   P   G   E   A   D   A

GCC CTG GTC CTA TGC GAC CCA CTT GGC CAG CCG CTC CGG GGC CCT GAA CGC CAC TTC GCC GCC GGC GCG CAT ATG
    ATA   AT   T             TA   A       ATAAA   A       AA             A   A   A   A
 A   L   V   L   C   D   P   L   G   Q   P   L   R   G   P   E   R   H   F   A   A   G   A   H   M

TGC GCG CAG GCG CGG GGG CTC CAG GCT TTT GTC CGT GTC GTG CCT CCA CCC GAG CGC CCC TGG GCC GAC GGG GGC
 T   A         AAA   ATA     A       AAA A   A                 A   AAA       A             AA
 C   A   Q   A   R   G   L   Q   A   F   V   R   V   V   P   P   P   E   R   P   W   A   D   G   G

GCC AGA GCG TGG GCG AAG TTC TTC CGC GGC TGC GCC TGG GCG CAG CGC TTG CTC GGC GAG CCA GCA GTT ATG CAC
    A       A     A         AA   AAA T     A       AA   ATA     A                     A         A
 A   R   A   W   A   K   F   F   R   G   C   A   W   A   Q   R   L   L   G   E   P   A   V   M   H

CTC CCA TAC ACC GAT GGC GAC GTG CCA CAG CTG ATC GCA CTG GCT TTG CGC ACG CTG GCC CAA CAG GGG GCC GCC
 TA         T     A         A           TA   A   AAA ATA   A                             A A A
 L   P   Y   T   D   G   D   V   P   Q   L   I   A   L   A   L   R   T   L   A   Q   Q   G   A   A

TTG GCA CTC TCG GTG CGT GAC CTG CCC GGG GGT GCA GCG TTC GAC GCA AAC GCG GTC ACC GCC GCC GTG CGC GCT
 A   TA   AAA       TA   A A       A                         A A AAA   A               AAA A
 L   A   L   S   V   R   D   L   P   G   G   A   A   F   D   A   N   A   V   T   A   A   V   R   A

GGC CCC GGC CAG TCC GCG GCC ACG TCA TCG CCA CCC GGC GAC CCC CCG CCG CCG CGC TGC GCA CGG CGA TCG CAA
 AAA   A         A A A       A         A A         A         A A AAA   T         AAA         A
 G   P   G   Q   S   A   A   T   S   S   P   P   G   D   P   P   P   R   C   A   R   R   S   Q

CGG CAC TCG GAC GCC CGC GGC ACT CCG CCC CCC GCG CCT GCG CGC GAC CCG CCG CCG CCC GCC CCC AGC CCG CCC
 AA    A       AAA A A A     A A AAA         A A A A AA TCA A A
 R   H   S   D   A   R   G   T   P   P   P   A   P   A   R   D   P   P   P   A   P   S   P   P

GCG CCA CCC CGC GCG GGT GAC CCG GTC CCT CCC ACT TCC GCG GGG CCG GCG GAT CGC GCG CGT GAC GCC GAG CTG
    A       AAA A       A   A A A A A A A A     AA AAA                               A       TA
 A   P   P   R   A   G   D   P   V   P   P   T   S   A   G   P   A   D   R   A   R   D   A   E   L

GAG GTC GCC TAC GAA CCG AGC GGC CCC CCC ACG TCA ACC AAG GCA GAC CCA GAC AGC GAC ATC GTT GAA AGT TAC
    A   A   T       ATCA   A   A A A       A                     TCA         A       TCA T
 E   V   A   Y   E   P   S   G   P   P   T   S   T   K   A   D   P   D   S   D   I   V   E   S   Y

GCC CGC GCC GCC GGA CCC GTG CAC CTC CGA GTC CGC GAC ATC ATG GAC CCA CCG CCC GGC TGC AAG GTC GTG GTC
 AAA   A       A       TAA       A                           A   A T       A A
 A   R   A   A   G   P   V   H   L   R   V   R   D   I   M   D   P   P   P   G   C   K   V   V   V

AAC GCC GCC AAC GAG GGG CTG CTG GCC GGC TCT GGC GTG TGC GGT GCC ATC TTT GCC AAC GCC ACG GCC CTC
    A   A         A   ATATA   A A A A   A   ATAA               A         A   A A AAA ATA
 N   A   A   N   E   G   L   L   A   G   S   G   V   C   G   A   I   F   A   N   A   T   A   A   L

GCT GCA GAC TGC CGG CGC CTC GCC CCA TGC CCC ACC GGC GAG GCA GTG GCG ACA CCC GGC CAC GGC TGC GGG TAC
    A         TAAAATA   A       T   A A           A         A A               A             ATAT
 A   A   D   C   R   R   L   A   P   C   P   T   G   E   A   V   A   T   P   G   H   G   C   G   Y

ACC CAC ATC ATC CAC GCC GTC GCG CCG CGG CGT CCT CGG GAC CCC GCC GCC CTC GAG GAG GGC GAA GCG CTG CTC
    A             A   A   AAAAA AAA       A   ATA       A         ATATA
 T   H   I   I   H   A   V   A   P   R   R   P   R   D   P   A   A   L   E   E   G   E   A   L   L

GAG CGC GCC TAC CGC AGC ATC GTC GCG CTA GCC GCC GCG CGT CGG TGG GCG CGT GTC GCG TGC CCC CTC CTC GGC
        AA   A   TAATCA           A AT       A   A   AAAAA       AAA   A   T ATATA   A
 E   R   A   Y   R   S   I   V   A   L   A   A   A   R   R   W   A   R   V   A   C   P   L   L   G

GCT GGC GTC TAC GGC TGG TCT GCT GCG GAG TCC CTC CGA GCC GCG CTC GCG GCT ACG CGC ACC GAG CCC GCC GAG
 A   A   AT A         A       AAA   A         ATAA   A   ATA     A   AT   A   A A AAA A       A AA
 A   G   V   Y   G   W   S   A   A   E   S   L   R   A   A   L   A   A   T   R   T   E   P   A   E

CGC GTG AGC CTG CAC ATC TGC CAT CCC GAC CGC GCC ACG CTG ACG CAC GCC TCC GTG CTC GTC GGC GCG GGG CTC
 AA   ATCATA       T       A       AA ATA         A       A   ATA   A   A   ATA
 R   V   S   L   H   I   C   R   P   D   R   A   T   L   T   H   A   S   V   L   V   G   A   G   L
```

FIG. 12C

```
GCT GCC AGG CGC GTC AGT CCT CCT CCG ACC GAG CCC CTC GCA TCT TGC CCC GCC GGT GAC CCG GGC CGA CCG GCT
 A   A   AAA  ATCA A   A   A       ATA       A    T    A AAA         A  AAA      A    A
 A   A   R   V   S   P   P   P   T   E   P   L   A   S   C   P   A   G   D   P   G   R   P   A

CAG CGC AGC GCG TCG CCC CCA GCG ACC CCC CTT GGG GAT GCC ACC GCG CCC GAG CCC CGC GGA TGC CAG GGG TGC
 AATCA A   A           A  ATA  A            A AAA            AAA         T       A T
 Q   R   S   A   S   P   P   A   T   P   L   G   D   A   T   A   P   E   R   G   C   Q   G   C

GAA CTC TGC CGG TAC ACG CGC GTC ACC AAT GAC CGC GCC TAT GTC AAC CTG TGG CTC GAG CGC GAC CGC GGC GCC
     TA  TAA  T  TAAA A       AAA       A    TA   TA      AA       AA A A
 E   L   C   R   Y   T   R   V   T   N   D   R   A   Y   V   N   L   W   L   E   R   D   R   G   A

ACC AGC TGG GCC ATG CGC ATT CCC GAG GTG GTT GTC TAC GGG CCG GAG CAC CTC GCC ACG CAT TTT CCA TTA AAC
 A TCA    A     AA    A       AAATA         TA A A
 T   S   W   A   M   R   I   P   E   V   V   V   Y   G   P   E   H   L   A   T   H   F   P   L   N

CAC TAC AGT GTG CTC AAG CCC GCG GAG GTC AGG CCC CCG CGA GGC ATG TGC GGG AGT GAC ATG TGG CGC TGC CGC
     T TCA  A T A       A A       A A A A A  A       T A TCA          AA  TAA
 H   Y   S   V   L   K   P   A   E   V   R   P   P   R   G   M   C   G   S   D   M   W   R   C   R

GGC TGG CAG GGC GTG CCG CAG GTG CGG TGC ACC CCC TCC AAC GCT CAC GCC GCC CTG TGC CGC ACA GGC GTG CCC
 A   A   A          AAA  T   A   A     A ATA TAA       A A A
 G   W   Q   G   V   P   Q   V   R   C   T   P   S   N   A   H   A   A   L   C   R   T   G   V   P

CCT CGG GTG AGC ACG CGA GGC GGC GAG CTA GAC CCA AAC ACC TGC TGG CTC CGC GCC GCC GCC AAC GTT GCG CAG
 AAA  ATCA  AA    A   T              A   T     TAAA A A A     AA
 P   R   V   S   T   R   G   G   E   L   D   P   N   T   C   W   L   R   A   A   A   N   V   A   Q

GCT GCG CGC GCC TGC GGC GCC TAC ACG AGT GCC GGG TGC CCC AGG TGC GCC TAC GGC CGC GCC CTG AGC GAA GCC
   A  AAA   A   T   A  T  ATCA  A   A  TA  A TA T  AAA A TCA   A
 A   A   R   A   G   A   Y   T   S   A   G   C   P   R   C   A   Y   G   R   A   L   S   E   A

CGC ACT CAT AAG GAC TTC GCC GCG CTG AGC CAG CGG TGG AGC GCG AGC CAC GCC GAT GCC TCC TCT GAC GGC ACC
AA  A            A   A TA TCA    AA      TCA A TCA     A   AAA       AA
 R   T   H   K   D   F   A   A   L   S   Q   R   W   S   A   S   H   A   D   A   S   S   D   G   T

GGA GAT CCC CTC GAC CCC CTG ATG GAG ACC GTG GGA TGC GCC TGT CGC GTG TGG GTC GGC TCC GAG CAC GAG
         ATA       ATA           A A      TA    AAA A       A AA
 G   D   P   L   D   P   L   M   E   T   V   G   C   A   C   S   R   V   W   V   G   S   E   H   E

GCC CCG CCC GAC CAC CTC CTG GTG TCC CTC CAC CGT GCC CCA AAT GGT CCG TGG GGC GTA GTG CTC GAG GTG CGT
 A   A   A         TATA A ATA      AA A              A     A       ATA         AAA
 A   P   P   D   H   L   L   V   S   L   H   R   A   P   N   G   P   W   G   V   V   L   E   V   R

GCG CGC CCC GAG GGG GGC AAC CCC ACC GGC CAC TTC GTC TGC GCG GTC GGC GGC GGC CCA CGC CGC GTC TCG GAC
 AAA  A      AA        A        ATA  A  A A A        AAAA  A A
 A   R   P   E   G   G   N   P   T   G   H   F   V   C   A   V   G   G   G   P   R   R   V   S   D

CGC CCC CAC CTT TGG CTC GCG GTC CCC CTG TCT CGG GGC GGT GGC ACC TGT GCC GCG ACC GAC GAG GGG CTG GCC
AA A   A    TA    A    ATA  A   A A  A A A A       A      A A A              ATA  A
 R   P   H   L   W   L   A   V   P   L   S   R   G   G   G   T   C   A   A   T   D   E   G   L   A

CAG GCG TAC TAC GAC GAC CTC GAG GTG CGC CGC CTC GGG GAT GAC GCC ATG GCC CGG GCG GCC CTC GCA TCA GTC
       A  T T         TA       AAAAATA A         A           AAA  A  ATA           A
 Q   A   Y   Y   D   D   L   E   V   R   R   L   G   D   D   A   M   A   R   A   A   L   A   S   V

CAA CGC CCT CGC AAA GGC CCT TAC AAT ATC AGG GTA TGG AAC ATG GCC GCA GGC GCT GGC AAG ACC ACC CGC ATC
        AA AAAA     A  AT       A         A         AAA      A      AAA
 Q   R   P   R   K   G   P   Y   N   I   R   V   W   N   M   A   A   G   A   G   K   T   T   R   I

CTC GCT GCC TTC ACG CGC GAA GAC CTT TAC GTC TGC CCC ACC AAT GCG CTC CTG CAC GAG ATC CAG GCC AAA CTC
TA  A   A        AAA             TA  T  A TA     ATATA                             A      TA
 L   A   A   F   T   R   E   D   L   Y   V   C   P   T   N   A   L   L   H   E   I   Q   A   K   L

CGC GCG CGC GAT ATC GAG ATC AAG AAC GCC GCC ACC TAC GAG CGC GCG CTG ACG AAA CCG CTC GCC GCC TAC CGC
AA A   AAA                     A   AAA  T       AA A ATA  A     ATA  A  A  IAA
 R   A   R   D   I   E   I   K   N   A   A   T   Y   E   R   A   L   T   K   P   L   A   A   Y   R

CGC ATC TAC ATC GAT GAG GCG TTC ACT CTC GGC GGC GAG TAC TGC GCG TTC GTT GCC AGC CAA ACC ACC CCG GAG
AA    T             A          ATA A  A        T  T  A        A  A TCA         A A A
 R   I   Y   Y   D   E   A   F   T   L   G   G   E   Y   C   A   F   V   A   S   Q   T   T   A   E

GTG ATC TGC GTC GGT GAT CGG GAC CAG TGC GGC CCA CAC TAC GCC AAT AAC TGC CGC ACC CCC GTC CCT GAC CGC
     A    T   A   AA        T   A                TA                  TAA A  A A A        AA
 V   I   C   V   G   D   R   D   Q   C   G   P   H   Y   A   N   N   C   R   T   P   V   P   D   R

TGG CCT ACC GAG CGC TCG CGC CAC ACT TGG CGC TTC CCC GAC TGC TGG GCG GCC CGC CTG CGC GCG GGG CTC GAT
   A   AA  AAAA                  A    AA       A   T       A  AAATAAA   A ATA
 W   P   T   E   R   S   R   H   T   W   R   F   P   D   C   W   A   A   R   L   R   A   G   L   D

TAT GAC ATC GAG GGC GAG CGC ACC GGC ACC TTC GCC TGC AAC CTT TGG GAC GGC CGC CAG GTC GAC CTT CAC CTC
         A    AA A A A           A    TA            AAA       A     TA      TA
 Y   D   I   E   G   E   R   T   G   T   F   A   C   N   L   W   D   G   R   Q   V   D   L   H   L
```

FIG. 12D

```
GCC TTC TCG CGC GAA ACC GTG CGC CGC CTT CAC GAG GCT GGC ATA CGC GCA TAC ACC GTG CGC GAG GCC CAG GGT
 A       AAA       A  AAAAATA             A       AA       T    AAA             A
 A  F    S   R   E   T   V   R   R   L   H   E   A   G   I   R   A   Y   T   V   R   E   A   Q   G

ATG AGC GTC GGC ACC GCC TGC ATC CAT GTA GGC AGA GAC GGC ACC GAC GTT GCC CTG GCG CTG ACA CGC GAC CTC
    TCA A   A   A   T           A                   A   A       A   ATA ATA         AA      T  A
 M   S   V   G   T   A   C   I   H   V   G   R   D   G   T   D   V   A   L   A   L   T   R   D   L

GCC ATC GTC AGC CTG ACC CGG GCC TCC GAC GCA CTC TAC CTC CAC GAG CTC GAG GAC GGC TCA CTG CGC GCT GCG
 A       ATCATA AAA A               TA  TTA         TA              A       TAAA    A
 A  I    V   S   L   T   R   A   S   D   A   L   Y   L   H   E   L   E   D   G   S   L   R   A   A

GGG CTC AGC GCG TTC CTC GAC GCC GGG GCA CTG GCG GAG CTC AAG GAG GTT CCC GCT GGC ATT GAC CGC GTT GTC
    A TATCA A       TA          A   A       TA      TA              AAAA            AAA A
 G   L   S   A   F   L   D   A   G   A   L   A   E   L   K   E   V   P   A   G   I   D   R   V   V

GCC GTC GAG CAG GCA CCA CCA CCG TTG CCG CCC GCC GAC GGC ATC CCC GAG GCC CAA GAC GTG CCG CCC TTC TGC
 A  A           AAAAA       A       A       A       AAA             T
 A  V    E   Q   A   P   P   P   L   P   P   A   D   G   I   P   E   A   Q   D   V   P   P   F   C

CCC CGC ACT CTG GAG GAG CTC GTC TTC GGC CGT GCC GGC CAC CCC CAT TAC GCG GAC CTC AAC CGC GTG ACT GAG
 AAA A TA               TA          AAAA        A       T  A   TA              AAA A
 P   R   T   L   E   E   L   V   F   G   R   A   G   H   P   H   Y   A   D   L   N   R   V   T   E

GGC GAA CGA GAA GTG CGG TAT ATG CGC ATC TCG CGT CAC CTG CTC AAC AAG AAT CAC ACC GAG ATG CCC GGA ACG
 A   A      AAA         AA      AAA     TATA                        A               A   A
 G   E   R   E   V   R   Y   M   R   I   S   R   H   L   L   N   K   N   H   T   E   M   P   G   T

GAA CGC GTT CTC AGT GCC GTT TGC GCC GTG CGG CGC TAC CGC GCG GGC GAG GAT GGG TCG ACC CTC CGC ACT GCT
    AA  ATATCA A   AT A   AAAAA TAA A               A   ATAAA A   A
 E   R   V   L   S   A   V   C   A   V   R   R   Y   R   A   G   E   D   G   S   T   L   R   T   A

GTG GCC CGC CAG CAC CCG CGC CCT TTT CGC CAG ATC CCA CCC CCG CGC GTC ACT GCT GGG GTC GCC CAG GAG TGG
 A  AAA         AAA A       AA              A   AAA A   A   A   A
 V   A   R   Q   H   P   R   F   F   R   Q   I   P   P   P   R   V   T   A   G   V   A   Q   E   W

CGC ATG ACG TAC TTG CGG GAA CGG ATC GAC CTC ACT GAC GTC TAC ACG CAG ATG GGC GTG GCC GCG CGG GAG CTC
 AA     A   T   AAA     AA          TA      A   TA              A   A       AAA         TA
 R   M   T   Y   L   R   E   R   I   D   L   T   D   V   Y   T   Q   M   G   V   A   A   R   E   L

ACC GAC CGC TAC GCG CGC CGC TAT CCT GAG ATC TTC GCC GGC ATG TGT ACC GCC CAG AGC CTG AGC GTC CCC GCC
 A      AA  T   AAAAA       A               AA          A   A   TCA TATCA A      A   A
 T   D   R   Y   A   R   R   Y   P   E   I   F   A   G   M   C   T   A   Q   S   L   S   V   P   A

TTC CTC AAA GCC ACC TTG AAG TGC GTA GAC GCC GCC CTC GGC CCC AGG GAC ACC GAG GAC TGC CAC GCC GCT CAG
    TA  AAA         A           A   ATA AAA A               A               T       AA
 F   L   K   A   T   L   K   C   V   D   A   A   L   G   P   R   D   T   E   D   C   H   A   A   Q

GGG AAA GCC GGC CTT GAG ATC CGT GCG TGG GCC AAG GAG TGG GTT CAG GTT ATG TCC CCG CAT TTC CGC GCG ATC
 A      A   ATA         AA  A                           A   A   AA              AAA A
 G   K   A   G   L   E   I   R   A   W   A   K   E   W   V   Q   V   M   S   P   H   F   R   A   I

CAG AAG ATC ATC ATG CGC GCC TTG CGC CCG CAA TTC CTT GTG GCC GCT GGC CAT ACG GAG CCC GAG GTC GAT GCG
                    AA  A   AAA A           TA  AAAA A           A       A           A           A
 Q   K   I   I   M   R   A   L   R   P   Q   F   L   V   A   A   G   H   T   E   P   E   V   D   A

TGG TGG CAG GCT CAT TAC ACC ACC AAC GCC ATC GAG GTC GAC TTC ACT GAG TTC GAC ATG AAC CAG ACC CTC GCT
                A       T  AA      A           A           A                           ATA A
 W   W   Q   A   H   Y   T   T   N   A   L   E   V   D   F   T   E   F   D   M   N   Q   T   L   A

ACT CGG GAC GTC GAG CTC GAG ATT AGC GCC GCT CTC TTG GGC CTC CCT TGC GCC GAA GAC TAC CGC GCG CTC CGC
 AAA        A   TA              TCA A   ATA A   ATA A   T               TAA ATAAA
 T   R   D   V   E   L   E   I   S   A   A   L   L   G   L   P   C   A   E   D   Y   R   A   L   R

GCC GGC AGC TAC TGC ACC CTG CGC GAA CTG GGC TCC ACT GAG ACC GGC TGC GAG CGC ACA AGC GGC GAG CCC GCC
 A  A TCA T T   ATAAA       TA  A   A           AAT        AA      TCA A           AA
 A   G   S   Y   C   T   L   R   E   L   G   S   T   E   T   G   C   E   R   T   S   G   E   P   A

ACG CTG CTG CAC AAC ACC ACC GTG GCC ATG TGC ATG GCC ATG CGC ATG GTC CCC AAA GGC GTG CGC TGG GCT GGG
    ATATA           A   A   A       T       A   AA          A   A       A   AAA         A  A
 T   L   L   H   N   I   T   V   A   M   C   M   A   M   R   M   V   P   K   G   V   R   W   A   G

ATT TTC CAG GGT GAC GAT ATG GTC ATC TTC CTC CCC GAG GGC GCG CGC AGT GCG GCA CTC AAG TGG ACC CCC GCC
                            A           TA  A       AAATCA      A   TA              A       A   A
 I   F   Q   G   D   D   M   V   I   F   L   P   E   G   A   R   S   A   A   L   K   W   T   P   A

GAG GTG GGC TTG TTC GGC TTC CAC ATC CCG GTG AAG CAT GTG AGC ACC CCT ACC CCC AGC TTC TGC GGG CAC GTC
    A  A    A       A               A   A                       ATCA A   A ATCA     T  A
 E   V   G   L   F   G   F   H   I   P   V   K   H   V   S   T   P   T   P   S   F   C   G   H   V

GGC ACC GCG GCC GGC CTC TTC CAT GAT GTC ATG CAC CAG GCG ATC AAG GTG CTT TGC CGC CGT TTC GAC CCA GAC
    A   A   A   ATA                 A                       A       ATA TAAAA
 G   T   A   A   G   L   F   H   D   V   M   H   Q   A   I   K   V   L   C   R   R   F   D   P   D
```

FIG. 12E

```
GTG CTT GAA GAA CAG CAG GTG GCC CTC CTC GAC CGC CTC CGG GGG GTC TAC GCG GCT CTG CCT GAC ACC GTT GCC
    ATA              A   ATATA      AATAAA   A   A   T   A ATA   A              A   A   A
 V   L   E   E   Q   Q   V   A   L   L   D   R   L   R   G   V   Y   A   A   L   P   D   T   V   A

GCC AAT GCT GCG TAC TAC GAC TAC AGC GCG GAG CGC GTC CTC GCT ATC GTG CGC GAA CTT ACC GCG TAC GCG CGG
     A   A   A   T   T        TTCA  A           AA   A           AAA      TA   A   T       AAA
 A   N   A   A   Y   Y   D   Y   S   A   E   R   V   L   A   I   V   R   E   L   T   A   Y   A   R

GGG CGC GGC CTC GAC CAC CCG GCC ACC ATC GGC GCG CTC GAG GAG ATT CAG ACC CCC TAC GCG CGC GCC AAT CTC
    AAA ATA          A   A           A   ATA                   A   AT AAA  A               TA
 G   R   G   L   D   H   P   A   T   I   G   A   L   E   E   I   Q   T   P   Y   A   R   A   N   L

CAC GAC GCT GAC TAA CGC CCC TGT ACG TGG GGC CTT TAA TCT TAC CTA CTC TAA CCA GGT CAT CAC CCA CCG TTG
             A
 H   D   A   D   *

TTT CGC CGC ATC TGG TGG GTA CCC AAC TTT TGC CAT TCG GGA GAG CCC CAG GGT GCC CGA ATG GCT TCT ACT ACC
                                                                                     A   A   A   A
                                                                                 M   A   S   T   T

CCC ATC ACC ATG GAG GAC CTC CAG AAG GCC CTC GAG ACA CAA TCC CGC GCC CTG CGC GCG GAA CTC GCC GCC GGC
    A       A           TA           A   ATA               AAA ATAAA  A       TA   A   A   A
 P   I   T   M   E   D   L   Q   K   A   L   E   T   Q   S   R   A   L   R   A   E   L   A   A   G

GCC TCG CAG TCG CGC CGG CCG CGG CCG CCG CGA CAG CGC GAC TCC AGC ACC ACC GGA GAT GAC TCC GGC CGT GAC
    A   A       AAAAA AAA   A   AA          AA          ATCA A   A                   A   AAA
 A   S   Q   S   R   R   P   R   P   P   R   Q   R   D   S   S   T   T   G   D   D   S   G   R   D

TCC GGA GGG CCC CGC CGC CGC CGC GGC AAC CGG GGC CGT GGC CAG CGC AGG GAC TGG TCC AGG GCC CCG CCC CCC
    A   A   AAAAAAAA A  AA  AAA  A         AA   A             AA   A       A   AAAAA A   A
 S   G   G   P   R   R   R   R   G   N   R   G   R   G   Q   R   R   D   W   S   R   A   P   P   P

CCG GAG GAG CGG CAA GAA ACT CGC TCC CAG ACT CCG GCC CCG AAG CCA TCG CGG GCG CCA CAA CAG CCT CAA
 A           AA          AAA  A      A   AAA          AAA   A    A                A
 P   E   E   R   Q   E   T   R   S   Q   T   P   A   P   K   P   S   R   A   P   P   Q   Q   P   Q

CCC CCG CGT ATG CAA ACC GGG CGT GGG GGC TCT GCC CCG CGC CCC GAG CTG GGG CCA CCG ACC AAC CCG TTC CAA
    A   AAA          A   AAA   A   A   A   AAA  A      TA       AA       A
 P   P   R   M   Q   T   G   R   G   G   S   A   P   R   P   E   L   G   P   P   T   N   P   F   Q

GCA GCC GTG GCG CGT GGC CTG CGC CCG CCT CTC CAC GAC CCT GAC ACC GAG GCA CCC ACC GAG GCC TGC GTG ACC
        A   A   AAA  ATAAA  A ATA           A       A           A   A               A   ATA  A
 A   A   V   A   R   G   L   R   P   P   L   H   D   P   D   T   E   A   P   T   E   A   C   V   T

TCA TGG CTT TGG AGC GAG GGC GAA GGC GCG GTC TTT TAC CGC GTC GAC CTG CAT TTC ACC AAC CTG GGC ACC CCC
        TA       TCA   A      A   A   A         TAA   A       TA           A   TA   A   A
 S   W   L   W   S   E   G   E   G   A   V   F   Y   R   V   D   L   H   F   T   N   L   G   T   P

CCA CTC GAC GAG GAC GGC CGC TGG GAC CCT GCG CTC ATG TAC AAC CCT TGC GGG CCC GAG CCG CCC GCT CAC GTC
    TA              AAA          A   ATA       T       A   TA   A           A   AA   A        A
 P   L   D   E   D   G   R   W   D   P   A   L   M   Y   N   P   C   G   P   E   P   P   A   H   V

GTC CGC GCG TAC AAT CAA CCT GCC GGC GAC GTC AGG GGC GTT TGG GGT AAA GGT GAG CGC ACC TAC GCC GAG CAG
    AAA   A   T          AA   A               A           A       A   A  AAA  A   T   A
 V   R   A   Y   N   Q   P   A   G   D   V   R   G   V   W   G   K   G   E   R   T   Y   A   E   Q

GAT TTC CGC GTC GGC GGC ACG CGC TGG CAC CGA CTG CTG CGC ATG CCA GTG CGC GGC CTC GAC GGC GAC AGC GCC
        AAA   A  AAA                A    TATAAA            AAA ATA                         TCA A
 D   F   R   V   G   G   T   R   W   H   R   L   L   R   M   P   V   R   G   L   D   G   D   S   A

CCG CTT CCC CCC CAC ACC ACC GAG CGC ATT GAG ACC CGC TCG GCG CGC CAT CCT TGG CGC ATC CGC TTC GGT GCC
    ATA  A       A   A      AA          AAA  A AAA          A       AA      AA           A   A
 P   L   P   P   H   T   T   E   R   I   E   T   R   S   A   R   H   P   W   R   I   R   F   G   A

CCC CAG GCC TTC CTT GCC GGG CTC TTG CTC GCC GCG GTC GCC GTT GGC ACC GCG CGC GCC GGG CTC CAG CCC CGC
 A   A       TA   A   ATA  ATA  A   A   A   A   A   A   AAA  A   ATA                         AAA
 P   Q   A   F   L   A   G   L   L   L   A   A   V   A   V   G   T   A   R   G   L   Q   P   R

GCT GAT ATG GCG GCA CCT CCT ACG CTG CCG CAG CCC CCC CGT GCG CAC GGG CAG CAT TAC GGC CAC CAC CAC CAT
     A       A         A  ATA  A         AAA  A       A                T   A
 A   D   M   A   A   P   P   T   L   P   Q   P   P   R   A   H   G   Q   H   Y   G   H   H   H   H

CAG CTG CCG TTC CTC GGG CAC GAC GGC CAT CAT GGC GGC ACC TTG CGC GTC GGC CAG CAT CAC CGA AAC GCC AGC
    TA   A      TA   A           A                AAA  AAAAA A           A                 A     TCA
 Q   L   P   F   L   G   H   D   G   H   H   G   G   T   L   R   V   G   Q   H   H   R   N   A   S

GAC GTG CTG CCC GGC CAC TGG CTC CAA GGC GGC TGG GGT GCC TAC AAC CTG AGC GAC TGG CAC CAG GGC ACT CAT
    ATA   A   A          TA          A   A          ATT       TATCA                         A   A
 D   V   L   P   G   H   W   L   Q   G   G   W   G   C   Y   N   L   S   D   W   H   Q   G   T   H

GTC TGT CAC ACC AAG CAC ATG GAC TTT TGG TGT GTG GAG CAC GAC CGA CCG CCG CCC GCG ACC CCG ACG CCT CTC
            A                            A            A   A   A   A   A   A   A   A   A ATA
 V   C   H   T   K   H   M   D   F   W   C   V   E   H   D   R   P   P   P   A   T   P   T   P   L
```

FIG. 12F

```
ACC ACC GCG GCG AAC TCC ACG ACC GCC GCC ACC CCC GCC ACT GCG CCG GCC CCC TGC CAC GCC GGC CTC AAT GAC
 A  A  A  A        A  A    A  A  A  A  A  A  A  A  A    A  A  A        A    A       A  ATA
 T  I  A  A  N  S  T  T  A  A  T  P  A  T  A  P  A  P  C  H  A  G  L  N  D

AGC TGC GGC GGC TTC TTG TCT GGG TGC GGG CCG ATG CGC CTG CGC CAC GGC GCT GAC ACC CGG TGC GGT CGG TTG
TCA  T  A  A       A  A  A    A     AATAA             A  A       AAA  T  AAA  A
 S  C  G  G  F  L  S  G  C  G  P  M  R  L  R  H  G  A  D  T  R  C  G  R  L

ATC TGC GGG CTG TCT ACC ACC GCC CAG TAC CCG CCT ACC CGG TTT GGC TGC GCT ATG CGG TGG GGC CTT CCC CCC
    T  ATA  A  A  A  A     T  A  A  AAA      A  T  A     AA        ATA  A  A
 I  C  G  L  S  T  T  A  Q  Y  P  P  T  R  F  G  C  A  M  R  W  G  L  P  P

TGG GAA CTG GTC GTC CTT ACC GCC CGC CCC GAA GAC GGC TGG ACT TGC CGC GGC GTG CCC GCC CAC CCA GGC ACC
       TA  A  ATA  A  AAA  A              A     A  TAA  A  A  A              AA
 W  E  L  V  V  L  T  A  R  P  E  D  G  W  T  C  R  G  V  P  A  H  P  G  T

CGC TGC CCC GAA CTG GTG AGC CCC ATG GGA CGC GCG ACT TGC TCC CCA GCC TCG GCC CTC TGG CTC GCC ACA GCG
AA  T  A     TA  A  ATCA  A        AA  A  A  T  A        A  A  ATA     TA  A        A
 R  C  P  E  L  V  S  P  M  G  R  A  T  C  S  P  A  S  A  L  W  L  A  T  A

AAC GCG CTG TCT CTT GAT CAC GCC CTC GCG GCC TTC GTC CTG CTG GTC CCG TGG GTC CTG ATA TTC ATG GTG TGC
    ATA  ATA           ATA  A  A          ATATA  A  A           ATA                       A  T
 N  A  L  S  L  D  H  A  L  A  A  F  V  L  L  V  P  W  V  L  I  F  M  V  C

CGC CGC ACC TGT CGC CGC CGC GGC GCC GCC GCC GCC CTC ACC GCG GTC GTC CTG CAG GGG TAC AAC CCC CCC GCC
AAAA  A     AAAAAA  A  A  A     ATA  A  A  ATA        A  T           AAA
 R  R  T  C  R  R  R  G  A  A  A  A  L  T  A  V  V  L  Q  G  Y  N  P  P  A

TAT GGC GAG GAG GCT TTC ACC TAC CTC TGC ACT GCA CCG GGG TGC GCC ACT CAA GCA CCT GTC CCC GTG CGC CTC
    A       A        ATTA  T  A        AATA  A              A  A     A  AAATA
 Y  G  E  E  A  F  T  Y  L  C  T  A  P  G  C  A  T  Q  A  P  V  P  V  R  L

GCT GGC GTC CGC TTT GAG TCC AAG ATT GTG GAC GGC GGC TGC TTT GCC CCA TGG GAC CTC GAG GCC ACT GGA GCC
 A  A  AAA        A        A  A     AAT  A  A          TA  A  A           A
 A  G  V  R  F  E  S  K  I  V  D  G  G  C  F  A  P  W  D  L  E  A  T  G  A

TGC ATT TGC GAG ATC CCC ACT GAT GTC TCG TGC GAG GGC TTG GGG GCC TGG GTA CCC ACA GCC CCT TGC GCG CGC
    T  T        AA      A  AT     AAAA              A        A  AT  AAA
 C  I  C  E  I  P  T  D  V  S  C  E  G  L  G  A  W  V  P  T  A  P  C  A  R

ATC TGG AAT GGC ACA CAG CGC GCG TGC ACC TTC TGG GCT GTC AAC GCC TAC TCC TCT GGC GGG TAC GCG CAG CTG
        A    AA  A  T  A        AA     A  ATA  A  AATA              T  A
 I  W  N  G  T  Q  R  A  C  T  F  W  A  V  N  A  Y  S  S  G  G  Y  A  Q  L

GCC TCT TAC TTC AAC CCT GGC GGC AGC TAC TAC AAG CAG TAC CAC CCT ACC GCG TGC GAG GTT GAA CCT GCC TTC
 A  A  T        A  A  ATCA  T  T           T     A  A  AT      A       A  A
 A  S  Y  F  N  P  G  G  S  Y  Y  K  Q  Y  H  P  T  A  C  E  V  E  P  A  F

GGA CAC AGC GAC GCG GCC TGC TGG GGC TTC CCC ACC GAC ACC GTG ATG AGC GTG TTC GCC CTT GCT AGC TAC GTC
           TCA     A  AT     A        AA     A  A     TCA  A        ATA  ATCA  T  A
 G  H  S  D  A  A  C  W  G  F  P  T  D  T  V  M  S  V  F  A  L  A  S  Y  V

CAG CAC CCT CAC AAG ACC GTC CGG GTC AAG TTC ATA CAG GAG ACC AGG ACC GTC TGG CAA CTC TCC GTT GCT GGC
    A     A  AAA  A                       AAA  A                    TA  A  A  A  A
 Q  H  P  H  K  T  V  R  V  K  F  H  T  E  T  R  T  V  W  Q  L  S  V  A  G

GTG TCG TGC AAC GTC ACC ACT GAA CAC CCG TTC TGC AAC ACG CCG CAC GGA CAA CTC GAG GTC CAG GTC CCG CCC
 A  A  T        A  A        A  A                       TA     A  AAA
 V  S  C  N  V  T  T  E  H  P  F  C  N  T  P  H  G  Q  L  E  V  Q  V  P  P

GAC CCC GGG GAC CTG GTT GAG TAC ATT ATG AAC CAC ACC GGC AAT CAG CAG TCC CGG TGG GGC CTC GGG AGC CCG
    A  A     TA  A     T              A  A           AAA           ATA  ATCA  A
 D  P  G  D  L  V  E  Y  I  M  N  H  T  G  N  Q  Q  S  R  W  G  L  G  S  P

AAT TGC CAT GGC CCC GAT TGG GCC TCC CCG GTT TGC CAA CGC CAT TCC CCT GAC TGC TCG CGG CTT GTG GGG GCT
    T     A  A           A  A  A  AT     AA     A  A           T     AAATA  A  A  A
 N  C  H  G  P  D  W  A  S  P  V  C  Q  R  H  S  P  D  C  S  R  L  V  G  A

ACG CCA GAG CGT CCC CGG CTG CGC CTG GTC GAC GCC GAC GAC CCC CTG CTG CGC ACT GCC CCT GGG CCC GGC GAG
 A     AA  AAATAAATA  A     A              ATATAAA  A  A  A  A
 T  P  E  R  P  R  L  R  L  V  D  A  D  D  P  L  R  T  A  P  G  P  G  E

GTG TGG GTC ACG CCT GTC ATA GGC TCT CAG GCG CGC AAG TGC GGA CTC CAC ATA CGC GCT GGA CCG TAC GGC CAT
    A     A  A        A  A  A        AAA  T     TA        AA  A        A  TA
 V  W  V  T  P  V  I  G  S  Q  A  R  K  C  G  L  H  I  R  A  G  P  Y  G  H

GCT ACC GTC GAA ATG CCC GAG TGG ATC CAC GCC CAC ACC ACC AGC GAC CCC TGG CAC CCA CCG GGC CCC TTG GGG
 A  A  A        A       A        A     A  ATCA     A                 A  A  A  A
 A  T  V  E  M  P  E  W  I  H  A  H  T  T  S  D  P  W  H  P  P  G  P  L  G

CTG AAG TTC AAG ACA GTT CGC CCG GTG GCC CTG CCA CGC ACG TTA GCG CCA CCC CGC AAT GTG CGT GTG ACC GGG
TA              AAA  A     ATA        AAA  A              A     AAA        AAA  A  A
 L  K  F  K  T  V  R  P  V  A  L  P  R  T  L  A  P  P  R  N  V  R  V  T  G
```

FIG. 12G

```
TGC TAC CAG TGC GGT ACC CCC GCG CTG GTG GAA GGC CTT GCC CCC GGG GGA GGG AAT TGC CAT CTC ACC GTC AAT
 T   T       T   A   A   ATA  A           ATA  A   A           A       I   TA   A   A
 C   Y   Q   C   G   T   P   A   L   V   E   G   L   A   P   G   G   G   N   C   H   L   T   V   N

GGC GAG GAT CTC GGC GCC TTC CCC CCT GGG AAG TTC GTC ACC GCC GCC CTC CTC AAC ACC CCC CCG CCC TAC CAA
 A       TA  A   A           A   A   A               A   A   A   ATATA       A   A   A   A   T
 G   E   D   L   G   A   F   P   P   G   K   F   V   I   A   A   L   L   N   T   P   P   P   Y   Q

GTC AGC TGC GGG GGC GAG AGC GAT CGC GCG AGC GCG CGG GTC ATT GAC CCC GCC GCG CAA TCG TTT ACC GGC GTG
 A   TCA T   A   A       TCA        AA  A   TCA AAA A                   A   A   A       A   A   A
 V   S   C   G   G   E   S   D   R   A   S   A   R   V   I   D   P   A   A   Q   S   F   T   G   V

GTG TAT GGC ACA CAC ACC ACT GCT GTG TCG GAG ACC CGG CAG ACC TGG GCG GAG TGG GCT GCT GCC CAT TGG TGG
 A       A       A   A   A   A   A       AAA        A   A           A   A           A   A   A
 V   Y   G   T   H   T   T   A   V   S   E   T   R   Q   T   W   A   E   W   A   A   A   H   W   W

CAG CTC ACT CTG GGC GCC ATT TGC GCC CTC CTA CTC GCT GGC TTA CTC GCT TGC TGT GCC AAA TGC TTG TAC TAC
 TA  ATA A   A           T   ATAT T   A   A           TA  A       TA  A   T   A               TA  T   T
 Q   L   T   L   G   A   I   C   A   L   L   L   A   G   L   L   A   C   C   A   K   C   L   Y   Y

TTG CGC GGC GCT ATA GCG CCG CGC TAG TGG GCC CCC GCG CGA AAC CCG CAC TAG CCC ACT AGA TTC CCG CAC CTG
 AAA A   A       A   AAA
 L   R   G   A   I   A   P   R   *

TTG CTG CAT AG
```

FIG. 13A

Varicella-zoster Virus, Human Herpesvirus 3
gH and gE genes attenuated; 9 amino acid codons modified
Oka vaccine strain (V-Oka) GenBank AB097932
Oka parental strain (P-Oka) GenBank AB097933
The two strains are identical in the gH and gE ORFs.

gH
65,959 V-Oka
65,935 P-Oka

```
ATG TTT GCG CTA GTT TTA GCG GTG GTA ATT CTT CCT CTT TGG ACC ACG GCT AAT AAA TCT TAC GTA ACA CCA ACC
        T       C C   T  C C   C   A       T T             AG     C   T  T   T
 M   F   A   L   V   L   A   V   V   I   L   P   L   W   T   T   A   N   K   S   Y   V   T   P   T

CCT GCG ACT CGC TCT ATC GGA CAT ATG TCT GCT CTT CTA CGA GAA TAT TCC GAC CGT AAT ATG TCT CTG AAA TTA
 T      A G AG       C       AG       A     A G        AGT    A G          AG   A        C
 P   A   T   R   S   I   G   H   M   S   A   L   R   E   Y   S   D   R   N   M   S   L   K   L

GAA GCC TTT TAT CCT ACT GGT TTC GAT GAA GAA CTC ATT AAA TCA CTT CAC TGG GGA AAT GAT AGA AAA CAC GTT
     T           C                        A  C   AGT A       C              G              C
 E   A   F   Y   P   T   G   F   D   E   E   L   I   K   S   L   H   W   G   N   D   R   K   H   V

TTC TTG GTT ATT GTT AAG GTT AAC CCT ACA ACA CAC GAA GGA GAC GTC GGG CTG GTT ATA TTT CCA AAA TAC TTG
     C A   C   C       C         T T         C           C A C C         T           C A
 F   L   V   I   V   K   V   N   P   T   T   H   E   G   D   V   G   L   V   I   F   P   K   Y   L

TTA TCG CCA TAC CAT TTC AAA GCA GAA CAT CGA GCA CCG TTT CCT GCT GGA CGT TTT GGA TTT CTT AGT CAC CCT
C   AGT T           T          A G T             C A G           C         A
 L   S   P   Y   H   F   K   A   E   H   R   A   P   F   P   A   G   R   F   G   F   L   S   H   P

GTG ACA CCC GAC GTG AGC TTC TTT GAC AGT TCG TTT GCG CCG TAT TTA ACT ACG CAA CAT CTT GTT GCG TTT ACT
  C   T T       C  T            AGT    T   T   C             T                A C T
 V   T   P   D   V   S   F   F   D   S   S   F   A   P   Y   L   T   T   Q   H   L   V   A   F   T

ACG TTC CCA CCA AAC CCC CTT GTA TGG CAT TTG GAA AGA GCT GAG ACC GCA GCA ACT GCA GAA AGG CCG TTT GGG
  T   T T   T    A   C          C A    G          T  T       T              T           C
 T   F   P   P   N   P   L   V   W   H   L   E   R   A   E   T   A   A   T   A   E   R   P   F   G

GTA AGT CTT TTA CCC GCT CGC CCA ACA GTC CCC AAG AAT ACT ATT CTT GAA CAT AAA GCG CAT TTT GCT ACA TGG
   C    A C   T       AG T T         T                     C A          T                  T
 V   S   L   L   P   A   R   P   T   V   P   K   N   T   I   L   E   H   K   A   H   F   A   T   W

GAT GCC CTT GCC CGA CAT ACT TTT TTT TCT GCC GAA GCA ATT ATC ACC AAC TCA ACG TTG AGA ATA CAC GTT CCC
      T   A   TAG               AG   T       T C         T        AGT T C A G       C       C T
 D   A   L   A   R   H   T   F   F   S   A   E   A   I   I   T   N   S   T   L   R   I   H   V   P

CTT TTT GGG TCG GTA TGG CCA ATT CGA TAC TGG GCC ACC GGT TCG GTG CTT CTC ACA AGC GAC TCG GGT CGT GTG
  A       C AGT C       T   C A G            T  T C  AGT C  A   T  T          AGT   C A G    C
 L   F   G   S   V   W   P   I   R   Y   W   A   T   G   S   V   L   L   T   S   D   S   G   R   V

GAA GTA AAT ATT GGT GTA GGA TTT ATG AGC TCG CTC ATT TCT TTA TCC TCT GGA CTA CCG ATA GAA TTA ATT GTT
       C      C  C  C  C            T AGT  A    CAG   C    AGT AG      C      T  C     C   C   C
 E   V   N   I   G   V   G   F   M   S   S   L   I   S   L   S   S   G   L   P   I   E   L   I   V

GTA CCA CAT ACA GTA AAA CTG AAC GCG GTT ACA AGC GAC ACC ACA TGG TTC CAG CTA AAT CCA CCG GGT CCG GAT
  C T       T   C       A        T   C T  T         T T                              T   T   C T
 V   P   H   T   V   K   L   N   A   V   T   S   D   T   T   W   F   Q   L   N   P   P   G   P   D

CCG GGG CCA TCT TAT CGA GTT TAT TTA CTT GGA CGT GGG TTG GAT ATG AAT TTT TCA AAG CAT GCT ACG GTC GAT
  T   C   T AG      A G      C       C       A   CAG   CCA               AGT           T
 P   G   P   S   Y   R   V   Y   L   L   G   R   G   L   D   M   N   F   S   K   H   A   T   V   D

ATA TGC GCA TAT CCC GAA GAG AGT TTG GAT TAC CGC TAT CAT TTA TCC ATG GCC CAC ACG GAG GCT CTG CGG ATG
       C      T       T         C A        A G            C  AGT    T        T         A A
 I   C   A   Y   P   E   E   S   L   D   Y   R   Y   H   L   S   M   A   H   T   E   A   L   R   M

ACA ACG AAG GCG GAT CAA CAT GAC ATA AAC GAG GAA AGC TAT TAC CAT ATC GCC GCA AGA ATA GCC ACA TCA ATT
  T   T       T           C                 T                     T  G   C    T      AGT   C
 T   T   K   A   D   Q   H   D   I   N   E   E   S   Y   Y   H   I   A   A   R   I   A   T   S   I

TTT GCG TTG TCG GAA ATG GGC CGT ACC ACA GAA TAT TTT CTG TTA GAT GAG ATC GTA GAT GTT CAG TAT CAA TTA
  T C A AGT          A G T T                 A C                      C           C              C
 F   A   L   S   E   M   G   R   T   T   E   Y   F   L   L   D   E   I   V   D   V   Q   Y   Q   L

AAA TTC CTT AAT TAC ATT TTA ATG CGG ATA GGA GCA GGA GCT CAT CCC AAC ACT ATA TCC GGA ACC TCG GAT CTG
         A           C C   A   C T C         T             C AGT    C  T AGT              A
 K   F   L   N   Y   I   L   M   R   I   G   A   G   A   H   P   N   T   I   S   G   T   S   D   L
```

FIG. 13B

```
ATC TTT GCC GAT CCA TCG CAG CTT CAT GAC GAA CTT TCA CTT CTT TTT GGT CAG GTA AAA CCC GCA AAT GTC GAT
        T       T AGT     A           A AGT   A   A         C          C         T T
 I   F   A   D   P   S   Q   L   H   D   E   L   S   L   L   F   G   Q   V   K   P   A   N   V   D

TAT TTT ATT TCA TAT GAT GAA GCC CGT GAT CAA CTA AAG ACC GCA TAC GCG CTT TCC CGT GGT CAA GAC CAT GTG
        C AGT           T A G                       T   T       T   A AGT AG   C                   C
 Y   F   I   S   Y   D   E   A   R   D   Q   L   K   T   A   Y   A   L   S   R   G   Q   D   H   V

AAT GCA CTT TCT CTC GCC AGG CGT GTT ATA ATG AGC ATA TAC AAG GGG CTG CTT GTG AAG CAA AAT TTA AAT GCT
        T   A AG   A T       A G C C               T C               C   A A   C                   C
 N   A   L   S   L   A   R   R   V   I   M   S   I   Y   K   G   L   L   V   K   Q   N   L   N   A

ACA GAG AGG CAG GCT TTA TTT TTT GCC TCA ATG ATT TTA TTA AAT TTC CGC GAA GGA CTA GAA AAT TCA TCT CGG
 T               C               T AGT   C C C           A G       C               AGT AG   A
 T   E   R   Q   A   L   F   F   A   S   M   I   L   L   N   F   R   E   G   L   E   N   S   S   R

GTA TTA GAC GGT CGC ACA ACT TTG CTT TTA ATG ACA TCC ATG TGT ACG GCA GCT CAC GCC ACG CAA GCA GCA CTT
  C C               C A G   T       C A   C           T AGT           T T               T T       T T A
 V   L   D   G   R   T   T   L   L   L   M   T   S   M   C   T   A   A   H   A   T   Q   A   A   L

AAC ATA CAA GAA GGC CTG GCA TAC TTA AAT CCT TCA AAA CAC ATG TTT ACA ATA CCA AAC GTA TAC AGT CCT TGT
     C               A T   C               AGT                           T C T               C
 N   I   Q   E   G   L   A   Y   L   N   P   S   K   H   M   F   T   I   P   N   V   Y   S   P   C

ATG GGT TCC CTT CGT ACA GAC CTC ACG GAA GAG ATT CAT GTT ATG AAT CTC CTG TCG GCA ATA CCA ACA CGC CCA
        C AGT   AAG T       A T             C       C           A   AGT   T     C T       TAG T
 M   G   S   L   R   T   D   L   T   E   E   I   H   V   M   N   L   L   S   A   I   P   T   R   P

GGA CTT AAC GAG GTA TTG CAT ACC CAA CTA GAC GAA TCT GAA ATA TTC GAC GCG GCA TTT AAA ACC ATG ATG ATT
     C   A           C C A       T                   AG       C             T T           T       C
 G   L   N   E   V   L   H   T   Q   L   D   E   S   E   I   F   D   A   A   F   K   T   M   M   I

TTT ACC ACA TGG ACT GCC AAA GAT TTG CAT ATA CTC CAC ACC CAT GTA CCA GAA GTA TTT ACG TGT CAA GAT GCA
        T   T       T           C A       C A       T       C T         C       T                   T
 F   T   T   W   T   A   K   D   L   H   I   L   H   T   H   V   P   E   V   F   T   C   Q   D   A

GCC GCG CGT AAC GGA GAA TAT GTG CTC ATT CTT CCA GCT GTC CAG GGA CAC AGT TAT GTG ATT ACA CGA AAC AAA
 T   TAG       C               C   A C A T               C                   C   C   TAG
 A   A   R   N   G   E   Y   V   L   I   L   P   A   V   Q   G   H   S   Y   V   I   T   R   N   K

CCT CAA AGG GGT TTG GTA TAT TCC CTG GCA GAT GTG GAT GTA TAT AAC CCC ATA TCC GTT GTT TAT TTA AGC AAG
            C C A C       AGT   A T         C           C           T   C AGT   C   C       C       T
 P   Q   R   G   L   V   Y   S   L   A   D   V   D   V   Y   N   P   I   S   V   V   Y   L   S   K

GAT ACT TGC GTG TCT GAA CAT GGT GTC ATA GAG ACG GTC GCA CTG CCC CAT CCG GAC AAT TTA AAA GAA TGT TTG
            C AG               C           C       T       T A T       T                           C A
 D   T   C   V   S   E   H   G   V   I   E   T   V   A   L   P   H   P   D   N   L   K   E   C   L

TAT TGC GGA AGT GTT TTT CTT AGG TAT CTA ACC ACG GGG GCG ATT ATG GAT ATA ATT ATT GAC AGC AAA GAT
            C               A           T   T C T C                           C C C C           T
 Y   C   G   S   V   F   L   R   Y   L   T   T   G   A   I   M   D   I   I   I   I   D   S   K   D

ACA GAA CGA CAA CTA GCC GCT ATG GGA AAC TCC ACA ATT CCA CCC TTC AAT CCA GAC ATG CAC GGG GAT GAC TCT
 T       A G           T               C       AGT   T   C T T               T                   AG
 T   E   R   Q   L   A   A   M   G   N   S   T   I   P   P   F   N   P   D   M   H   G   D   D   S

AAG GCT GTG TTG TTG TTT CCA AAC GGA ACT GTG GTA ACG CTT CTA GGA TTC GAA CGA CGA CAA GCC ATA CGA ATG
        C C A C A       T           C           C C T A           C           A G A G       T   C A G
 K   A   V   L   L   F   P   N   G   T   V   V   T   L   L   G   F   E   R   R   Q   A   I   R   M

TCG GGA CAA TAC CTT GGG GCC TCT TTA GGA GGG GCG TTT CTG GCG GTA GTG GGG TTT GGT ATT ATC GGA TGG ATG
AGT   C               A C   T AG   C       C   T           A T C C C           C C           C
 S   G   Q   Y   L   G   A   S   L   G   G   A   F   L   A   V   V   G   F   G   I   I   G   W   M

TTA TGT GGA AAT TCC CGC CTT CGA GAA TAT AAT AAA ATA CCT CTG ACA TAA
  C       C       AGT A G   A A G                   C       A   T
 L   C   G   N   S   R   L   R   E   Y   N   K   I   P   L   T   |stop
                                                                  68,484 V-Oka
                                                                  68,460 P-Oka
```

FIG. 14A

```
gE
115,901 V-Oka
115,913 P-Oka
|
ATG GGG ACA GTT AAT AAA CCT GTG GTG GGG GTA TTG ATG GGG TTC GGA ATT ATC ACG GGA ACG TTG CGT ATA ACG
        C   T   C               C   C   C   CCA         C       C   C       T   C   TCAAG C   T
 M   G   T   V   N   K   P   V   V   G   V   L   M   G   F   G   I   I   T   G   T   L   R   I   T

AAT CCG GTC AGA GCA TCC GTC TTG CGA TAC GAT GAT TTC CAC ATC GAT GAA GAC AAA CTG GAT ACA AAC TCC GTA
        T       G   T   AGT     C A A G                                     A       T       AGT C
 N   P   V   R   A   S   V   L   R   Y   D   D   F   H   I   D   E   D   K   L   D   T   N   S   V

TAT GAG CCT TAC TAC CAT TCA GAT CAT GCG GAG TCT TCA TGG GTA AAT CGG GGA GAG TCT TCG CGA AAA GCG TAC
                        AGT             T       AG  AGT         C       A       C       AG  AGT A G               T
 Y   E   P   Y   Y   H   S   D   H   A   E   S   S   W   V   N   R   G   E   S   S   R   K   A   Y

GAT CAT AAC TCA CCT TAT ATA TGG CCA CGT AAT GAT TAT GAT GGA TTT TTA GAG AAC GCA CAC GAA CAC CAT GGG
            AGT     C               T A G                       C   C               T                       C
 D   H   N   S   P   Y   I   W   P   R   N   D   Y   D   G   F   L   E   N   A   H   E   H   H   G

GTG TAT AAT CAG GGC CGT GGT ATC GAT AGC GGG GAA CGG TTA ATG CAA CCC ACA CAA ATG TCT GCA CAG GAG GAT
 C                  A G     C               T   A           C               T T                 AG  T
 V   Y   N   Q   G   R   G   I   D   S   G   E   R   L   M   Q   P   T   Q   M   S   A   Q   E   D

CTT GGG GAC GAT ACG GGC ATC CAC GTT ATC CCT ACG TTA AAC GGC GAT GAC AGA CAT AAA ATT GTA AAT GTG GAC
 A   C           T                   C           T C                       G               C C         C
 L   G   D   D   T   G   I   H   V   I   P   T   L   N   G   D   D   R   H   K   I   V   N   V   D

CAA CGT CAA TAC GGT GAC GTG TTT AAA GGA GAT CTT AAT CCA AAA CCC CAA GGC CAA AGA CTC ATT GAG GTG TCA
 A G                 C           C               C       A           T       T                       G       A   C               C AGT
 Q   R   Q   Y   G   D   V   F   K   G   D   L   N   P   K   F   Q   G   Q   R   L   I   E   V   S

GTG GAA GAA AAT CAC CCG TTT ACT TTA CGC GCA CCG ATT CAG GGG ATT TAT GGA GTC CGG TAC ACC GAG ACT TGG
     C                       T               C   AG  T   T   C               A               C               A               T
 V   E   E   N   H   P   F   T   L   R   A   P   I   Q   R   I   Y   G   V   R   Y   T   E   T   W

AGC TTT TTG CCG TCA TTA ACC TGT ACG GGA GAC GCA GCG CCC GCC ATC CAG CAT ATA TGT TTA AAA CAT ACA ACA
     T       CA  T AGT C           T           T C               T           T T T                       C       C                       T T
 S   F   L   P   S   L   T   C   T   G   D   A   A   P   A   I   Q   H   I   C   L   K   H   T   T

TGC TTT CAA GAC GTG GTG GTG GAT GTG GAT TGC GCG GAA AAT ACT AAA GAG GAT CAG TTG GCC GAA ATC AGT TAC
                         C   C   C           C               T                                       C   A   T
 C   F   Q   D   V   V   V   D   V   D   C   A   E   N   T   K   E   D   Q   L   A   E   I   S   Y

CGT TTT CAA GGT AAG AAG GAA GCG GAC CAA CCG TGG ATT GTT GTA AAC ACG AGC ACA CTG TTT GAT GAA CTC GAA
A G                 C               C                       T                       C   C               T T T       A                                       A
 R   F   Q   G   K   K   E   A   D   Q   P   W   I   V   V   N   T   S   T   L   F   D   E   L   E

TTA GAC CCC CCC GAG ATT GAA CCG GGT GTC TTG AAA GTA CTT CGG ACA GAA AAA CAA TAC TTG GGT GTG TAC ATT
 C           T   T           C           T   C           CA              C   A A           T               C A   C   C                       C
 L   D   P   P   E   I   E   P   G   V   L   K   V   L   R   T   E   K   Q   Y   L   G   V   Y   I

TGG AAC ATG CGC GGC TCC GAT GGT ACG TCT ACC TAC GCC ACG TTT TTG GTC ACC TGG AAA GGG GAT GAA AAA ACA
             A G         AGT           C   T AG      T               T   T           CA          T                       C                       T
 W   N   M   R   G   S   D   G   T   S   T   Y   A   T   F   L   V   T   W   K   G   D   E   K   T

AGA AAC CCT ACG CCC GCA GTA ACT CCT CAA CCA AGA GGG GCT GAG TTT CAT ATG TGG AAT TAC CAC TCG CAT GTA
     G           T   T   T   C                       T       G   C                                                   AGT                           C
 R   N   P   T   P   A   V   T   P   Q   P   R   G   A   E   F   H   M   W   N   Y   H   S   H   V

TTT TCA GTT GGT GAT ACG TTT AGC TTG GCA ATG CAT CTT CAG TAT AAG ATA CAT GAA GCG CCA TTT GAT TTG CTG
         AGT   C   C           T           T C A   T                   A                       C                       T   T                       C A   A
 F   S   V   G   D   T   F   S   L   A   M   H   L   Q   Y   K   I   H   E   A   P   F   D   L   L

TTA GAG TGG TTG TAT GTC CCC ATC GAT CCT ACA TGT CAA CCA ATG CGG TTA TAT TCT ACG TGT TTG TAT CAT CCC
 C           C A               T               T                       T           A   C           AG  T           C A                       T
 L   E   W   L   Y   V   P   I   D   P   T   C   Q   P   M   R   L   Y   S   T   C   L   Y   H   P

AAC GCA CCC CAA TGC CTC TCT CAT ATG AAT TCC GGT TGT ACA TTT ACC TCG CCA CAT TTA GCC CAG CGT GTT GCA
     T   T                       A AG              AGT C           T               T AGT T       C                   AG  C   T
 N   A   P   Q   C   L   S   H   M   N   S   G   C   T   F   I   S   P   H   L   A   Q   R   V   A

AGC ACA GTG TAT CAA AAT TGT GAA CAT GCA GAT AAC TAC ACC GCA TAT TGT CTG GGA ATA TCT CAT ATG GAG CCT
 T   T   C                       T                       T               T                       A   C   AG
 S   T   V   Y   Q   N   C   E   H   A   D   N   Y   T   A   Y   C   L   G   I   S   H   M   E   P
```

FIG. 14B

```
AGC TTT GGT CTA ATC TTA CAC GAC GGG GGC ACC ACG TTA AAG TTT GTA GAT ACA CCC GAG AGT TTG TCG GGA TTA
 T   C           C            C        T  T C              C            T   T       C A AGT    C C
 S   F   G   L   I   L   H   D   G   G   T   T   L   K   F   V   D   T   P   E   S   L   S   G   L

TAC GTT TTT GTG GTG TAT TTT AAC GGG CAT GTT GAA GCC GTA GCA TAC ACT GTT GTA TCC ACA GTA GAT CAT TTT
     C       C   C               C       C       T C T             C  C AGT  T   C
 Y   V   F   V   V   Y   F   N   G   H   V   E   A   V   A   Y   T   V   V   S   T   V   D   H   F

GTA AAC GCA ATT GAA GAG CGT GGA TTT CCG CCA ACG GCC GGT CAG CCA CCG GCG ACT ACT AAA CCC AAG GAA ATT
     C       T  C           A G  C       T  T  T  C        T  T  T                    T            C
 V   N   A   I   E   R   G   F   P   P   T   A   G   Q   P   P   A   T   T   K   P   K   E   I

ACC CCC GTA AAC CCC GGA ACG TCA CCA CTT CTA CGA TAT GCC GCA TGG ACC GGA GGG CTT GCA GCA GTA GTA CTT
     T   C          T   C   T AGT T   A       A G       T   T           T       C   A   T   T   C   A
 T   P   V   N   P   G   T   S   P   L   L   R   Y   A   A   W   T   G   L   A   A   V   V   L

TTA TGT CTC GTA ATA TTT TTA ATC TGT ACG GCT AAA CGA ATG AGG GTT AAA GCC TAT AGG GTA GAC AAG TCC CCG
 C       A   C       C               T           A G           C       T               C           AGT T
 L   C   L   V   I   F   L   I   C   T   A   K   R   M   R   V   K   A   Y   R   V   D   K   S   P

TAT AAC CAA AGC ATG TAT TAC GCT GGC CTT CCA GTG GAC GAT TTC GAG GAC TCG GAA TCT ACG GAT ACG GAA GAA
         T                      A  T  C                       AGT        AG   T        T
 Y   N   Q   S   M   Y   Y   A   G   L   P   V   D   D   F   E   D   S   E   S   T   D   T   E   E

GAG TTT GGT AAC GCG ATT GGA GGG AGT CAC GGG GGT TCG AGT TAC ACG GTG TAT ATA GAT AAG ACC CGG TGA
         C       T   C   C               C   C AGT        T   C       C            T A |
 E   F   G   N   A   I   G   G   S   H   G   G   S   Y   T   V   Y   I   D   K   T   R | stop
                                                                                V-Oka 117,772
                                                                                P-Oka 117,784
```

```
GAC CCT GAC AAG ATC CTA ACA TAC ATT GCT GCC GAT CAC TGC CCG GTA GTC GAG GTG AAC GGC GTG ACC ATC CAA
  G               T   G               G   G                           A           A               A   G
 D   P   D   K   I   L   T   Y   I   A   A   D   H   C   P   V   V   E   V   N   G   V   T   I   Q

GTC GGG AGC AGG AGG TAT CCA GAC GCT GTG TAC TTG CAC AGA ATT GAC CTC GGT CCT CCC ATA TCA TTG GAG AGG
  A   C TCG C C C           G       G   A       C T       C C           T   C   G           G C T       C C
 V   G   S   R   R   Y   P   D   A   V   Y   L   H   R   I   D   L   G   P   P   I   S   L   E   R

TTG GAC GTA GGG ACA AAT CTG GGG AAT GCA ATT GCT AAG TTG GAG GAT GCC AAG GAA TTG TTG GAG TCA TCG GAC
C T           C   G       T   C       G       G   C T               G           C T C T           G
 L   D   V   G   T   N   L   G   N   A   I   A   K   L   E   D   A   K   E   L   L   E   S   S   D

CAG ATA TTG AGG AGT ATG AAA GGT TTA TCG AGC ACT AGC ATA GTC TAC ATC CTG ATT GCA GTG TGT CTT GGA GGG
      C T C C TCG           C C T       TCG   G TCG       A           T       G   A           C   C
 Q   I   L   R   S   M   K   G   L   S   S   T   S   I   V   Y   I   L   I   A   V   C   L   G   G

TTG ATA GGG ATC CCC GCT TTA ATA TGT TGC TGC AGG GGG CGT TGT AAC AAA AAG GGA GAA CAA GTT GGT ATG TCA
C T       C       G   G C T               C C   C   C               C               A   C           G
 L   I   G   I   P   A   L   I   C   C   R   G   R   C   N   K   K   G   E   Q   V   G   M   S

AGA CCA GGC CTA AAG CCT GAT CTT ACG GGA ACA TCA AAA TCC TAT GTA AGG TCG CTC TGA TCC TCT ACA ACT CTT
C C   G       I       G           C   G   G           G           C C       T
 R   P   G   L   K   P   D   L   T   G   T   S   K   S   Y   V   R   S   L

GAA ACA CAA ATG TCC CAC AAG TCT CCT CTT CGT CAT CAA GCA ACC ACC GCA CCC AGC ATC AAG CCC ACC TGA AAT

TAT CTC CGG CTT CCC TCT GGC CGA ACA ATA TCG GTA GTT AAT CAA AA
```

FIG. 16A

```
AGGGT GCA AGA TCA TCC ACA ATG TCA CCA CAA CGA GAC CGG ATA AAT GCC TTC TAC AAA GAT AAC CCC CAT CCC AAG
            G   G       C       C                                           G               G
            M   S   P   Q   R   D   R   I   N   A   F   Y   K   D   N   P   H   P   K

GGA AGT AGG ATA GTC ATT AAC AGA GAA CAT CTT ATG ATT GAT AGA CCT TAT GTT TTG CTG GCT GTT CTG TTT GTC
  C TCG C   C           A           C C                   C C   G       ACT T   GAT                A
G   S   R   I   V   I   N   R   E   H   L   M   I   D   R   P   Y   V   L   L   A   V   L   F   V

ATG TTT CTG AGC TTG ATC GGG TTG CTA GCC ATT GCA GGC ATA AGA CTT CAT CGG GCA GCC ATC TAC ACC GCA GAG
        T   TCG C   T           CCT T   G           G           C C           C   G           G   G
M   F   L   S   L   I   G   L   L   A   I   A   G   I   R   L   H   R   A   A   I   Y   T   A   E

ATC CAT AAA AGC CTC AGC ACC AAT CTA GAT GTA ACT AAC TCA ATC GAG CAT CAG GTC AAG GAC GTG CTG ACA CCA
            TCG T   TCG G       T           G           G               A           A   T   G   G
I   H   K   S   L   S   T   N   L   D   V   T   N   S   I   E   H   Q   V   K   D   V   L   T   P

CTC TTC AAA ATC ATC GGT GAT GAA GTG GGC CTG AGG ACA CCT CAG AGA TTC ACT GAC CTA GTG AAA TTA ATC TCT
  T             C           A           TCC G           C C           G       T   A       C T     G
L   F   K   I   I   G   D   E   V   G   L   R   T   P   Q   R   F   T   D   L   V   K   L   I   S

GAC AAG ATT AAA TTC CTT AAT CCG GAT AGG GAG TAC GAC TTC AGA GAT CTC ACT TGG TGT ATC AAC CCG CCA GAG
                              C C               T   G           C C       T   G                    G
D   K   I   K   F   L   N   P   D   R   E   Y   D   F   R   D   L   T   W   C   I   N   P   P   E

AGA ATC AAA TTG GAT TAT GAT CAA TAC TGT GCA GAT GTG GCT GCT GAA GAG CTC ATG AAT GCA TTG GTG AAC TCA
  C C           C T             A   G G                           I           GCT A               G
R   I   K   L   D   Y   D   Q   Y   C   A   D   V   A   A   E   E   L   M   N   A   L   V   N   S

ACT CTA CTG GAG ACC AGA ACA ACC AAT CAG TTC CTA GCT GTC TCA AAG GGA AAC TGC TCA GGG CCC ACT ACA ATC
  G T   T           GCC G           G               T   G   A G           C           G   C   GGG
T   L   L   E   T   R   T   T   N   Q   F   L   A   V   S   K   G   N   C   S   G   P   T   T   I

AGA GGT CAA TTC TCA AAC ATG TCG CTG TCC CTG TTA GAC TTG TAT TTA GGT CGA GGT TAC AAT GTG TCA TCT ATA
  C C   C               G       T   G   TCT     C T     C T C C                       A   G   G
R   G   Q   F   S   N   M   S   L   S   L   L   D   L   Y   L   G   R   G   Y   N   V   S   S   I

GTC ACT ATG ACA TCC CAG GGA ATG TAT GGG GGA ACT TAC CTA GTG GAA AAG CCT AAT CTG AGC AGC AAA AGG TCA
  A   G         G G       C           C C G           T A           G       T TCG TCG         C C G
V   T   M   T   S   Q   G   M   Y   G   G   T   Y   L   V   E   K   P   N   L   S   S   K   R   S

GAG TTG TCA CAA CTG AGC ATG TAC CGA GTG TTT GAA GTA GGT GTT ATC AGA AAT CCG GGT TTG GGG GCT CCG GTG
  C T   G       T TCG           C   A               C   A       C C           CCT C   G           A
E   L   S   Q   L   S   M   Y   R   V   F   E   V   G   V   I   R   N   P   G   L   G   A   P   V

TTC CAT ATG ACA AAC TAT CTT GAG CAA CCA GTC AGT AAT GAT CTC AGC AAC TGT ATG GTG GCT TTG GGG GAG CTC
        G                       G   A TCG         T TCG                           A   GCT C       T
F   H   M   T   N   Y   L   E   Q   P   V   S   N   D   L   S   N   C   M   V   A   L   G   E   L

AAA CTC GCA GCC CTT TGT CAC GGG GAA GAT TCT ATC ACA ATT CCC TAT CAG GGA TCA GGG AAA GGT GTC AGC TTC
        T   G   G           C           G           G           C G C           C       A TCG
K   L   A   A   L   C   H   G   E   D   S   I   T   I   P   Y   Q   G   S   G   K   G   V   S   F

CAG CTC GTC AAG CTA GGT GTC TGG AAA TCC CCA ACC GAC ATG CAA TCC TGG GTC CCC TTA TCA ACG GAT GAT CCA
        T   A       T C   A             G G G                   G           A   GCT G               G
Q   L   V   K   L   G   V   W   K   S   P   T   D   M   Q   S   W   V   P   L   S   T   D   D   P

GTG ATA GAC AGG CTT TAC CTC TCA TCT CAC AGA GGT GTT ATC GCT GAC AAT CAA GCA AAA TGG GCT GTC CCG ACA
  A       C C           T   G       G G       C C   A                   G               G   A     G
V   I   D   R   L   Y   S   S   H   R   G   V   I   A   D   N   Q   A   K   W   A   V   P   T

ACA CGA ACA GAT GAC AAG TTG CGA ATG GAG ACA TGC TTC CAA CAG GCG TGT AAG GGT AAA ATC CAA GCA CTC TGC
  G C   G               C T C           G                               C                   G T
T   R   T   D   D   K   L   R   M   E   T   C   F   Q   Q   A   C   K   G   K   I   Q   A   L   C

GAG AAT CCC GAG TGG GCA CCA TTG AAG GAT AAC AGG ATT CCT TCA TAC GGG GTC TTG TCT GTT GAT CTG AGT CTG
            G           G   GCT             C C           G G       C   ACT G   A       T TCG T
E   N   P   E   W   A   P   L   K   D   N   R   I   P   S   Y   G   V   L   S   V   D   L   S   L

ACA GTT GAG CTT AAA ATC AAA ATT GCT TCG GGA TTC GGG CCA TTG ATC ACA CAC GGT TCA GGG ATG GAC CTA TAC
  G   A                     G           C           C   GCT             G           C   G   C     T
T   V   E   L   K   I   K   I   A   S   G   F   G   P   L   I   T   H   G   S   G   M   D   L   Y

AAA TCC AAC CAC AAC AAT GTG TAT TGG CTG ACT ATC CCG CCA ATG AAG AAC CTA GCC TTA GGT GTA ATC AAC ACA
      G     A               T   G           G                           T   GCT C                 G
K   S   N   H   N   N   V   Y   W   L   T   I   P   P   M   K   N   L   A   L   G   V   I   N   T

TTG GAG TGG ATA CCG AGA TTC AAG GTT AGT CCC TAC CTC TTC ACT GTC CCA ATT AAG GAA GCA GGC GAA GAC TGC
  C T           C C             A TCG         T     G   A
L   E   W   I   P   R   F   K   V   S   P   Y   L   F   T   V   P   I   K   E   A   G   E   D   C

CAT GCC CCA ACA TAC CTA CCT GCG GAG GTG GAT GGT GAT GTC AAA CTC AGT TCC AAT CTG GTG ATT CTA CCT GGT
        GGG         T   G       A           C           A       T TCG G               T A         T GC
H   A   P   T   Y   L   P   A   E   V   D   G   D   V   K   L   S   S   N   L   V   I   L   P   G
```

FIG. 16B

```
CAA GAT CTC CAA TAT GTT TTG GCA ACC TAC GAT ACT TCC AGG GTT GAA CAT GCT GTG GTT TAT TAC GTT TAC AGC
        T         A C T  G   G            G   G C C  A              G   A  A            A       TCG
 Q   D   L   Q   Y   V   L   A   T   Y   D   T   S   R   V   E   H   A   V   V   Y   Y   V   Y   S

CCA AGC CGC TCA TTT TCT TAC TTT TAT CCT TTT AGG TTG CCT ATA AAG GGG GTC CCC ATC GAA TTA CAA GTG GAA
  G TCG      G       G                   G       C C C T  G          C   A  G            C T       A
 P   S   R   S   F   S   Y   F   Y   P   F   R   L   P   I   K   G   V   P   I   E   L   Q   V   E

TGC TTC ACA TGG GAC CAA AAA CTC TGG TGC CGT CAC TTC TGT GTG CTT GCG GAC TCA GAA TCT GGT GGA CAT ATC
        G                    T           C               A              G           G C C
 C   F   T   W   D   Q   K   L   W   C   R   H   F   C   V   L   A   D   S   E   S   G   G   H   I

ACT CAC TCT GGG ATG GTG GGC ATG GGA GTC AGC TGC ACA GTC ACC CGG GAA GAT GGA ACC AAT CGC AGA TAG GGC
  G       G   C       A           C   A TCG     G   A  G   C           C   G              C C
 T   H   S   G   M   V   G   M   G   V   S   C   T   V   T   R   E   D   G   T   N   R   R

TGC TAG TGA ACC AAT CAC ATG ATG TCA CCC AGA CAT CAG GCA TAC CCA CTA GTG TGA AAT AGA CAT CAG AAT TAA
GAA AAA
```

FIG. 17A

```
GGGG CAA ATA ACA ATG GAG TTG CTA ATC CTC AAA GCA AAT GCA ATT ACC ACA ATC CTC ACT GCA GTC ACA TTT TGT
                         C   G       G   G       G       G       GG      GGG     GGG       GG
                         M   E   L   L   I   L   K   A   N   A   I   T   T   I   L   T   A   V   T   F   C

TTT GCT TCT GGT CAA AAC ATC ACT GAA GAA TTT TAT CAA TCA ACA TGC AGT GCA GTT AGC AAA GGC TAT CTT AGT
    G   G   G               G   G   G           G   G   TCG G       TCG     G       G TCG
F   A   S   G   Q   N   I   T   E   E   F   Y   Q   S   T   C   S   A   V   S   K   G   Y   L   S

GCT CTG AGA ACT GGT TGG TAT ACC AGT GTT ATA ACT ATA GAA TTA AGT AAT ATC AAG GAA AAT AAG TGT AAT GGA
    G       CG  G       G     G TCG             G       G C G TCG               G                   G
A   L   R   T   G   W   Y   T   S   V   I   T   I   E   L   S   N   I   K   E   N   K   C   N   G

ACA GAT GCT AAG GTA AAA TTG ATA AAA CAA GAA TTA GAT AAA TAT AAA AAT GCT GTA ACA GAA TTG CAG TTG CTC
    G           G           C               GCG                   G       G GC     C           G
T   D   A   K   V   K   L   I   K   Q   E   L   D   K   Y   K   N   A   V   T   E   L   Q   L   L

ATG CAA AGC ACA CCA GCA ACA AAC AAT CGA GCC AGA AGA GAA CTA CCA AGG TTT ATG AAT TAT ACA CTC AAC AAT
        TCG G   G   G           G   G CGCG G       G   GC                                  G   G
M   Q   S   T   P   A   T   N   N   R   A   R   R   E   L   P   R   F   M   N   Y   T   L   N   N

GCC AAA AAA ACC AAT GTA ACA TTA AGC AAG AAA AGG AAA AGA AGA TTT CTT GGT TTT TTG TTA GGT GTT GGA TCT
    G                       G C G TCG           C           CG G       GG      C CG     G           GG
A   K   K   T   N   V   T   L   S   K   K   R   K   R   R   F   L   G   F   L   L   G   V   G   S

GCA ATC GCC AGT GGC GTT GCT GTA TCT AAG GTC CTG CAC CTA GAA GGG GAA GTG AAC AAG ATC AAA AGT GCT CTA
    G       G TCG G       G       G                       G       G                       TCG G
A   I   A   S   G   V   A   V   S   K   V   L   H   L   E   G   E   V   N   K   I   K   S   A   L

CTA TCC ACA AAC AAG GCT GTA GTC AGC TTA TCA AAT GGA GTT AGT GTC TTA ACC AGC AAA GTG TTA GAC CTC AAA
    G   G           G           TCG C G         G       TCG     C G G TCG         C G         G
L   S   T   N   K   A   V   V   S   L   S   N   G   V   S   V   L   T   S   K   V   L   D   L   K

AAC TAT ATA GAT AAA CAA TTG TTA CCT ATT GTC AAC AAG CAA AGC TGC AGC ATA TCA AAT ATA GCA ACT GTG ATA
                        C   CG  G                       TCG     TCG     G           G   G
N   Y   I   D   K   Q   L   L   P   I   V   N   K   Q   S   C   S   I   S   N   I   A   T   V   I

GAG TTC CAA CAA AAG AAC AAC AGA CTA CTA GAG ATT ACC AGG GAA TTT AGT GTT AAT GCA GGT GTA ACT ACA CCT
                            C G CG  G           G C     G       TCG         G G             G G G
E   F   Q   Q   K   N   N   R   L   L   E   I   T   R   E   F   S   V   N   A   G   V   T   T   P

GTA AGC ACT TAC ATG TTA ACT AAT AGT GAA TTA TTG TCA TTA ATC AAT GAT ATG CCT ATA ACA AAT GAT CAG AAA
    TCG G           CG  G       TCG    GCGC       GCG               G                   G
V   S   T   Y   M   L   T   N   S   E   L   L   S   L   I   N   D   M   P   I   T   N   D   Q   K

AAG TTA ATG TCC AAC AAT GTT CAA ATA GTT AGA CAG CAA AGT TAC TCT ATC ATG TCC ATA ATA AAA GAG GAA GTC
    C G                             C G         TCG     G                               G
K   L   M   S   N   N   V   Q   I   V   R   Q   Q   S   Y   S   I   M   S   I   I   K   E   E   V

TTA GCA TAT GTA GTA CAA TTA CCA CTA TAT GGT GTT ATA GAT ACA CCC TGT TGG AAA CTA CAC ACA TCC CCT CTA
C G G               C G G           G                           G G             G       G G G
L   A   Y   V   V   Q   L   P   L   Y   G   V   I   D   T   P   C   W   K   L   H   T   S   P   L

TGT ACA ACC AAC ACA AAA GAA GGG TCC AAC ATC TGT TTA ACA AGA ACT GAC AGA GGA TGG TAC TGT GAC AAT GCA
        G       G       G       G           CG  GCG G       CG  G                                   G
C   T   T   N   T   K   E   G   S   N   I   C   L   T   R   T   D   R   G   W   Y   C   D   N   A

GGA TCA GTA TCT TTC TTC CCA CAA GCT GAA ACA TGT AAA GTT CAA TCA AAT CGA GTA TTT TGT GAC ACA ATG AAC
    G       G               G       G   G               G       G                           G
G   S   V   S   F   F   P   Q   A   E   T   C   K   V   Q   S   N   R   V   F   C   D   T   M   N

AGT TTA ACA TTA CCA AGT GAA GTA AAT CTC TGC AAT GTT GAC ATA TTC AAC CCC AAA TAT GAT TGT AAA ATT ATG
TCG C G     GCG     G TCG G         G                                       G
S   L   T   L   P   S   E   V   N   L   C   N   V   D   I   F   N   P   K   Y   D   C   K   I   M

ACT TCA AAA ACA GAT GTA AGC AGC TCC GTT ATC ACA TCT CTA GGA GCC ATT GTG TCA TGC TAT GGC AAA ACT AAA
    G   G       G           TCG TCG G               G           G   G   G               G       G
T   S   K   T   D   V   S   S   S   V   I   T   S   L   G   A   I   V   S   C   Y   G   K   T   K

TGT ACA GCA TCC AAT AAA AAT CGT GGA ATC ATA AAG ACA TTT TCT AAC GGG TGC GAT TAT GTA TCA AAT AAA GGG
            G   G   G               G           G                                                   G
C   T   A   S   N   K   N   R   G   I   I   K   T   F   S   N   G   C   D   Y   V   S   N   K   G

GTG GAC ACT GTG TCT GTA GGT AAC ACA TTA TAT TAT GTA AAT AAG CAA GAA GGT AAA AGT CTC TAT GTA AAA GGT
                                    G           GCG                     G   G   TCG
V   D   T   V   S   V   G   N   T   L   Y   Y   V   N   K   Q   E   G   K   S   L   Y   V   K   G

GAA CCA ATA ATA AAT TTC TAT GAC CCA TTA GTA TTC CCC TCT GAT GAA TTT GAT GCA TCA ATA TCT CAA GTC AAC
    G                                   GCG         G   G       G           G   G       G
E   P   I   I   N   F   Y   D   P   L   V   F   P   S   D   E   F   D   A   S   I   S   Q   V   N

GAG AAG ATT AAC CAG AGC CTA GCA TTT ATT CGT AAA TCC GAT GAA TTA TTA CAT AAT GTA AAT GCT GGT AAA TCC
                TCG G   G                   G           G               GCGCG              G       G
E   K   I   N   Q   S   L   A   F   I   R   K   S   D   E   L   L   H   N   V   N   A   G   K   S
```

FIG. 17B

```
ACC ATA AAT ATC ATG ATA ACT ACT ATA ATT ATA GTG ATT ATA GTA ATA TTG TTA TCA TTA ATT GCT GTT GGA CTG
 G                       G   G                                       C   CG  GCG          G       G
T   I   N   I   M   I   T   T   I   I   I   V   I   I   V   I   L   L   S   L   I   A   V   G   L

CTC TTA TAC TGT AAG GCC AGA AGC ACA CCA GTC ACA CTA AGC AAA GAT CAA CTG AGT GGT ATA AAT AAT ATT GCA
 GCG               GCG TCG  G   G           G   GTCG                TCG  G                       G
L   L   Y   C   K   A   R   S   T   P   V   T   L   S   K   D   Q   L   S   G   I   N   N   I   A

TTT AGT AAC TAA ATA AAA ATA GCA CCT AAT CAT GTT CTT ACA ATG GTT TAC TAT CTG CTC ATA GAC AAC CCA TCT
    TCG
F   S   N

GTC ATT GGA TTT TCT TAA AAT CTG AAC TTC ATC GAA ACT CTC ATC TAT AAA CCA TCT CAC TTA CAC TAT TTA AGT

AGA TTC CTA GTT TAT AGT TAT ATA AAA
```

FIG. 18

```
GGG GCA AAT GCA AAC ATG TCC AAA AAC AAG GAC CAA CGC ACC GCT AAG ACA TTA GAA AGG ACC TGG GAC ACT CTC
            G                                  G   G      GCG GC   G               G   G
             M   S   K   N   K   D   Q   R   T   A   K   T   L   E   R   T   W   D   T   L

AAT CAT TTA TTA TTC ATA TCA TCG TGC TTA TAT AAG TTA AAT CTT AAA TCT GTA GCA CAA ATC ACA TTA TCC ATT
    C G C G              G           C G       C G      G       G       G               GCG G
 N   H   L   L   F   I   S   S   C   L   Y   K   L   N   L   K   S   V   A   Q   I   T   L   S   I

CTG GCA ATG ATA ATC TCA ACT TCA CTT ATA ATT GCA GCC ATC ATA TTC ATA GCC TCG GCA AAC CAC AAA GTC ACA
    G               G   G   G   G           G                           G   G                   G
 L   A   M   I   S   T   S   L   I   I   A   A   I   I   F   I   A   S   A   N   H   K   V   T

CCA ACA ACT GCA ATC ATA CAA GAT GCA ACA AGC CAG ATC AAG AAC ACA ACC CCA ACA TAC CTC ACC CAG AAT CCT
    G   G   G                   G   G TCG                       G   G       G   G               G
 P   T   T   A   I   I   Q   D   A   T   S   Q   I   K   N   T   T   P   T   Y   L   T   Q   N   P

CAG CTT GGA ATC AGT CCC TCT AAT CCG TCT GAA ATT ACA TCA CAA ATC ACC ACC ATA CTA GCT TCA ACA ACA CCA
    G   G       TCG G   G                           G   G           G   G       G   G   G   G   G
 Q   L   G   I   S   P   S   N   P   S   E   I   T   S   Q   I   T   T   I   L   A   S   T   T   P

GGA GTC AAG TCA ACC CTG CAA TCC ACA ACA GTC AAG ACC AAA AAC ACA ACA ACA ACT CAA ACA CAA CCC AGC AAG
 G              G           G   G           G                   G   G   G       G           G TCG
 G   V   K   S   T   L   Q   S   T   T   V   K   T   N   T   T   T   T   Q   T   Q   P   S   K

CCC ACC ACA AAA CAA CGC CAA AAC AAA CCA CCA AGC AAA CCC AAT AAT GAT TTT CAC TTT GAA GTG TTC AAC TTT
 G   G   G           G              G   G TCG       G                                   G
 P   T   T   K   Q   R   Q   N   K   P   P   S   K   P   N   N   D   F   H   F   E   V   F   N   F

GTA CCC TGC AGC ATA TGC AGC AAC AAT CCA ACC TGC TGG GCT ATC TGC AAA AGA ATA CCA AAC AAA AAA CCA GGA
        G   TCG         TCG         G   G           G           C G     G                   G   G
 V   P   C   S   I   C   S   N   N   P   T   C   W   A   I   C   K   R   I   P   N   K   K   P   G

AAG AAA ACC ACT ACC AAG CCC ACA AAA AAA CCA ACC CTC AAG ACA ACC AAA AAA GAT CCC AAA CCT CAA ACC ACT
            G   G       G   G           G   G           G   G                   G   G       G   G
 K   K   T   T   T   K   P   T   K   K   P   T   L   K   T   T   K   D   P   K   P   Q   T   T

AAA TCA AAG GAA GTA CCC ACC ACC AAG CCC ACA GAA GAG CCA ACC ATC AAC ACC ACC AAA ACA AAC ATC ATA ACT
        G   G       G   G   G       G   G           G   G           G   G   G                   G
 K   S   K   E   V   P   T   T   K   P   T   E   E   P   T   I   N   T   T   K   T   N   I   I   T

ACA CTA CTC ACC TCC AAC ACC ACA GGA ATT CCA GAA CTC ACA AGT CAA ATG GAA ACC TTC CAC TCA ACT TCC TCC
 G   G   G   G           G   G   G TCG         G           G   G G TCG              G   G   G   G
 T   L   L   T   S   N   T   T   G   N   P   E   L   T   S   Q   M   E   T   F   H   S   T   S   S

GAA GGC AAT CCA AGC CCT TCT CAA GTC TCT ACA ACA TCC GAG TAC CCA TCA CAA CCT TCA TCT CCA CCC AAC ACA
        G       G TCG G   G         G   G   G       G   G           G   G       G   G   G   G   G
 E   G   N   P   S   P   S   Q   V   S   T   T   S   E   Y   P   S   Q   P   S   S   P   P   N   T

CCA CGC CAG TAG TTA CTT AAA AA
 G   G
 P   R   Q
```

FIG. 19

```
CAA AAA CTT CCC GGA AAT GAC AAC AGC ACG GCA ACG CTG TGC CTT GGG CAC CAT GCA GTA CCA AAC GGA ACG ATT
    T A   G C                 TCG         G     T A     T A   C             G           G       C       C
Q   K   L   P   G   N   D   N   S   T   A   T   L   C   L   G   H   A   V   P   N   G   T   I

GTG AAA ACA ATC ACG AAT GAC CAA ATT GAA GTT ACT AAT GCT ACT GAG CTG GTT CAG AGT TCC TCA ACA GGT GGA
        G                       C           G           G       T A       TCG   G   G   C   C
V   K   T   I   T   N   D   Q   I   E   V   T   N   A   T   E   L   V   Q   S   S   S   T   G   G

ATA TGC GAC AGT CCT CAT CAG ATC CTT GAT GGA GAA AAC TGC ACA CTA ATA GAT GCT CTA TTG GGA GAC CCT CAG
  C         TCG G           T A       C                   G T   C       T   A   C           G
I   C   D   S   P   H   Q   I   L   D   G   E   N   C   T   L   I   D   A   L   L   G   D   P   Q

TGT GAT GGC TTC CAA AAT AAG AAA TGG GAC CTT TTT GTT GAA CGC AGC AAA GCC TAC AGC AAC TGT TAC CCT TAT
                            T A                           TCG       G       TCG                       G
C   D   G   F   Q   N   K   K   W   D   L   F   V   E   R   S   K   A   Y   S   N   C   Y   P   Y

GAT GTG CCG GAT TAT GCC TCC CTT AGG TCA CTA GTT GCC TCA TCC GGC ACA CTG GAG TTT AAC AAT GAA AGC TTC
            G   G T A C C   G T             G   G   G       G T A                           TCG
D   V   P   D   Y   A   S   L   R   S   L   V   A   S   S   G   T   L   E   F   N   N   E   S   F

AAT TGG ACT GGA GTC ACT CAG AAT GGA ACA AGC TCT GCT TGC AAA AGG AGA TCT AAT AAA AGT TTC TTT AGT AGA
          G   C       G               C   G TCG   G           C C C C   G           TCG         TCG C C
N   W   T   G   V   T   Q   N   G   T   S   S   A   C   K   R   R   S   N   K   S   F   F   S   R

TTG AAT TGG TTG ACC CAT TTA AAA TAC AAA TAC CCA GCA TTG AAC GTG ACT ATG CCA AAC AAT GAA AAA TTT GAC
  A         A   G                           G   G A         G       G       G
L   N   W   L   T   H   L   K   Y   K   Y   P   A   L   N   V   T   M   P   N   N   E   K   F   D

AAA TTG TAC ATT TGG GGG GTT CAC CAC CCG GGT ACG GAC AGT GAC CAA ATC AGC CTA TAT GCT CAA GCA TCA GGA
    A       C       C                   C           TCG         TCG T                           G   C
K   L   Y   I   W   G   V   H   H   P   G   T   D   S   D   Q   I   S   L   Y   A   Q   A   S   G

AGA ATC ACA GTC TCT ACC AAA AGA AGC CAA CAA ACT GTA ATC CCG AAT ATC GGA TCT AGA CCC AGG GTA AGG GAT
C C       G         G   G   C C TCG             G                     C   G C C   G C C           C C
R   I   T   V   S   T   K   R   S   Q   Q   T   V   I   P   N   I   G   S   R   P   R   V   R   D

GTC TCC AGC AGA ATA AGC ATC TAT TGG ACA ATA GTA AAA CCG GGA GAC ATA CTT TTG ATT AAC AGC ACA GGG AAT
      G TCG C C   C TCG             G   C                     C           C T A   A   C   TCG   G   C
V   S   S   R   I   S   I   Y   W   T   I   V   K   P   G   D   I   L   L   I   N   S   T   G   N

CTA ATT GCT CCT AGG GGT TAC TTC AAA ATA CGA AGT GGG AAA AGC TCA ATA ATG AGA TCA GAT GCA CCC ATT GGC
T     C         G C C   C               C   C TCG   C       TCG G   C         C C G         G G C
L   I   A   P   R   G   Y   F   K   I   R   S   G   K   S   S   I   M   R   S   D   A   P   I   G

AAA TGC AAT TCT GAA TGC ATC ACT CCA AAT GGA AGC ATT CCC AAT GAC AAA CCA TTT CAA AAT GTA AAC AGG ATC
        G               G   G       C TCG   C   G               G                                 C C
K   C   N   S   E   C   I   T   P   N   G   S   I   P   N   D   K   P   F   Q   N   V   N   R   I

ACA TAT GGG GCC TGT CCC AGA TAT GTT AAG CAA AAC ACT CTG AAA TTG GCA ACA GGG ATG CGA AAT GTA CCA GAG
    G       C   G       G C C               G T A       A   G G C           C                       G
T   Y   G   A   C   P   R   Y   V   K   Q   N   T   L   K   L   A   T   G   M   R   N   V   P   E

AAA CAA ACT AGA GGC ATA TTT GGC GCA ATC GCG GGT TTC ATA GAA AAT GGT TGG GAG GGA ATG GTG G
            G C C     C           G         C       C           C           C
K   Q   T   R   G   I   F   G   A   I   A   G   F   I   E   N   G   W   E   G   M   V
```

FIG. 20

```
AAA GCA GGA GTG AAn ATG AAT CCA AAT CAA AAG ATA ATA ACG ATT GGC TCT GTT TCT CTC ACC ATT TCC ACA ATA
      G  C            G              C  C        C        G        GTA  G  C  G  G  C
 K   A   G   V   X   M   N   P   N   Q   K   I   L   T   I   G   S   V   S   L   T   I   S   T   I

TGC TTC TTC ATG CAA ATT GCC ATC CTG ATA ACT ACT GTA ACA TTG CAT TTC AAG CAA TAT GAA TTC AAC TCC CCC
              C   G         TA  C  GG            G  A                                        G  G
 C   F   F   M   Q   I   A   I   L   I   T   T   V   T   L   H   F   K   Q   Y   E   F   N   S   P

CCA AAC AAC CAA GTG ATG CTG TGT GAA CCA ACA ATA ATA GAA AGA AAC ATA ACA GAG ATA GTG TAT CTG ACC AAC
  G              TA              G  G  C  C        CC        C  G                   TA  G
 P   N   N   Q   V   M   L   C   E   P   T   I   I   E   R   N   I   T   E   I   V   Y   L   T   N

ACC ACC ATA GAG AAG GAA ATA TGC CCC AAA CTA GCA GAA TAC AGA AAT TGG TCA AAG CCG CAA TGT AAC ATT ACA
  G  G  C              C        G        T  G                 CC                 G                    C  G
 T   T   I   E   K   E   I   C   P   K   L   A   E   Y   R   N   W   S   K   P   Q   C   N   I   T

GGA TTT GCA CCT TTT TCT AAG GAC AAT TCG ATT CGG CTT TCC GCT GGT GGG GAC ATC TGG GTG ACA AGA GAA CCT
      C          GG      G                  C   CTA  G   GC  C                         GCC           G
 G   F   A   P   F   S   K   D   N   S   I   R   L   S   A   G   G   D   I   W   V   T   R   E   P

TAT GTG TCA TGC GAT CCT GAC AAG TGT TAT CAA TTT GCC CTT GGA CAG GGA ACA ACA CTA AAC AAC GTG CAT TCA
              G         G                        GTA  C        C  GT                                  G
 Y   V   S   C   D   P   D   K   C   Y   Q   F   A   L   G   Q   G   T   T   L   N   N   V   H   S

AAT GAC ACA GTA CAT GAT AGG ACC CCT TAT CGG ACC CTA TTG ATG AAT GAG TTG GGT GTT CCA TTT CAT CTG GGG
              G            CC  G         C  GT  A              A  C        G              TA  C
 N   D   T   V   H   D   R   T   P   Y   R   T   L   M   N   E   L   G   V   P   F   H   L   G

ACC AAG CAA GTG TGC ATA GCA TGG TCC AGC TCA AGT TGT CAC GAT GGA AAG GCA TGG CTG CAT GTT TGT GTA ACG
  G              C   G  TCG  G  TCG                C        G           TA
 T   K   Q   V   C   I   A   W   S   S   S   S   C   H   D   G   K   A   W   L   H   V   C   V   T

GGG GAT GAT GAA AAT GCA ACT GCT AGC TTC ATT TAC AAT GGG AGG CTT GTA GAT AGT ATT GTT TCA TGG TCC AAA
  C         G  G  TCG             CCCTA              TCG  C        G        G
 G   D   D   E   N   A   T   A   S   F   I   Y   N   G   R   L   V   D   S   I   V   S   W   S   K

AAA ATC CTC AGG ACC CAG GAG TCA GAA TGC GTT TGT ATC AAT GGA ACT TGT ACA GTA GTA ATG ACT GAT GGG AGT
      TACCG         G                           C  G                G              G           C  TCG
 K   I   L   R   T   Q   E   S   E   C   V   C   I   N   G   T   C   T   V   V   M   T   D   G   S

GCT TCA GGA AAA GCT GAT ACT AAA ATA CTA TTC ATT GAG GAG GGG AAA ATC GTT CAT ACT AGC ACA TTG TCA GGA
  G  G  C        G        G        CT        C              C              G TCG  G  A  G  C
 A   S   G   K   A   D   T   K   I   L   F   I   E   E   G   K   I   V   H   T   S   T   L   S   G

AGT GCT CAG CAT GTC GAG GAG TGC TCC TGT TAT CCT CGA TAT CCT GGT GTC AGA TGT GTC TGC AGA GAC AAC TGG
TCG  G                             G           G  C        G  C        CC                 C  C
 S   A   Q   H   V   E   E   C   S   C   Y   P   R   Y   P   G   V   R   C   V   C   R   D   N   W

AAA GGC TCC AAT AGG CCC ATC GTA GAT ATA AAC ATA AAG GAT TAT AGC ATT GTT CCA GTT TAT GTG TGC TCA GGA
      G        CC  G              C              C              TCG  C        G TCG              G  C
 K   G   S   N   R   P   I   V   D   I   N   I   K   D   Y   S   I   V   S   S   Y   V   C   S   G

CTT GTT GGA GAC ACA CCC AGA AAA AAC GAC AGC TCC AGC AGT AGC CAT TGC TTG GAT CCA AAC AAT GAG GAA GGT
T  A        C        G  GCC              TCG  G TCG TCG TCG        A        G                    C
 L   V   G   D   T   P   R   K   N   D   S   S   S   S   S   H   C   L   D   P   N   N   E   E   G

GGT CAT GGA GTG AAA GGC TGG GCC TTT GAT GAT GGA AAT GAC GTG TGG ATG GGA AGA ACG ATC AGC GAG AAG TTA
  C  C                       G              C                        CCC        TCG
 G   H   G   V   K   G   W   A   F   D   D   G   N   D   V   W   M   G   R   T   I   S   E   K   L

CGC TCA GGA TAT GAA ACC TTC AAA GTC ATT GAA GGC TGG TCC AAC CCT AAC TCC AAA TTG CAG ATA AAT AGG CAA
  G  C                                 C              G        G        G        A              CC
 R   S   G   Y   E   T   F   K   V   I   E   G   W   S   N   P   N   S   K   L   Q   I   N   R   Q

GTC ATA GTT GAC AGA GGT AAT AGG TCC GGT TAT TCT GGT ATT TTC TCT GTT GAA GGC AAA AGC TGC ATC AAT CGG
      C            CC  C        CC  G  C              G  C  C        G                 TCG           C
 V   I   V   D   R   G   N   R   S   G   Y   S   G   I   F   S   V   E   G   K   S   C   I   N   R

TGC TTT TAT GTG GAG TTG ATA AGG GGA AGA AAA CAA GAA ACT GAA GTC TTG TGG ACC TCA AAC AGT ATT GTT GTG
              A       CCC    CCC                       G        A        GG  TCG  C
 C   F   Y   V   E   L   I   R   G   R   K   Q   E   T   E   V   L   W   T   S   N   S   I   V   V

TTT TGT GGC ACC TCA GGT ACA TAT GGA ACA GGC TCA TGG CCT GAT GGG GCG GAC ATC AAT CTC ATG CCT ATA TAA
              G  G  C        C  G              G        G             TA        G  C
 F   C   G   T   S   G   T   Y   G   T   G   S   W   P   D   G   A   D   I   N   L   M   P   I   *

GCT TTC GCA ATT TTA GAA AAA ACT CCT TGT TTC C
  G        C                  G  G
 A   F   A   I   L   E   K   T   P   C   F
```

```
GCG TCA ATA ACG CTG ACG GTA CAG GCC AGA CTA TTG TTG TCT GGT ATA GTG CAG CAG CAA AAC AAT CTG CTG AGG
    G       C       C           GCT CCCCC   G           C                               C   CCT
 A   S   I   T   L   T   V   Q   A   R   L   L   L   S   G   I   V   Q   Q   Q   N   N   L   L   R

GCT ATA GAG GCG CAA CAG CAT CTG TTG CAA CTC ACA GTC TGG GGC ATT AAG CAG CTC CAG ACA AGA ATC TTG GCT
 G                          C C C           G       T                           GCT     CC  G
 A   I   E   A   Q   Q   H   L   L   Q   L   T   V   W   G   I   K   Q   L   Q   T   R   I   L   A

GTA GAA AGA TAC CTA AAG GAT CAA CAG CTC CTA GGG ATT TGG GGC TGC TCT GGA AAA CTC ATC TGC ACC ACT GCT
    C    CT      C              T           C T                G T                          G   G G
 V   E   R   Y   L   K   D   Q   Q   L   L   G   I   W   G   C   S   G   K   L   I   C   T   T   A

GTG CCT TGG AAC TCC AGT TGG AGT AAT AGA TCT CAT GAT GAG ATT TGG GAT AAC ATG ACC TGG ATG CAG TGG GAT
  C   G         G TCG     TCG     C T   G                                   G
 V   P   W   N   S   S   W   S   N   R   S   H   D   E   I   W   D   N   M   T   W   M   Q   W   D

AGA GAA ATT AAT AAT TAC ACA GAC ACA ATA TAC AGG TTG CTT GAA GAA TCA CAA AAC CAG CAG GAG AAA AAT GAA
 C T                G       G               C T C C   C               G
 R   E   I   N   N   Y   T   D   T   I   Y   R   L   L   E   S   Q   N   Q   Q   E   K   N   E

AAG GAT TTA TTA GCA TTG GAC AGT TGG CAA AAT CTG TGG AAT TGG TTT AGC ATA ACA AAT TGG CTG TGG TAT ATA
        C C C C   G C C     TCG             C                   TCG     G           C
 K   D   L   L   A   L   D   S   W   Q   N   L   W   N   W   F   S   I   T   N   W   L   W   Y   I

AAA ATA TTC ATA ATG ATA GTA GGA GGC TTG ATA GGT TTA AGA ATA ATT TTT GCT GTG CTT TCT ATA GTG AAT AGA
                C   T   T C C           C C C T                     G   C   C   G           C   C T
 K   I   F   I   M   I   V   G   G   L   I   G   L   R   I   I   F   A   V   L   S   I   V   N   R

GTT AGG CAG GGA TAC TCA CCT CTG CCG TTT CAG ACC CTT ACC CCG AAC CCA AGG GAA CCC GAC AGG CTC GGA AGA
    C C T       T       G G   C                 G   C   G               GCT         G   C T         TCT
 V   R   Q   G   Y   S   P   L   F   F   Q   T   L   T   P   N   P   R   E   P   D   R   L   G   R

ATC GAA GAA GAA GGT GGA GAG CAA GAC AGA GGC AGA TCC ATT CGC TTA GTG AGC GGA TTC TTA GCG CTT GCC TGG
                        T               C T   TCT   G       TCC   C TCG   T         C C         C   G
 I   E   E   E   G   G   E   Q   D   R   G   R   S   I   R   L   V   S   G   F   L   A   L   A   W

GAC GAC CTG CGG AGC CTG TGC CTT TTC AGC TAC CAC CGA TTG AGA GAC TTC ATA TTG ATT GCA GCA AGA GTG TTG
        C   T TCG   C       C           TCG         T C C T                 C C         G   GCT   C C C
 D   D   L   R   S   L   C   F   S   Y   H   R   L   R   D   F   I   L   I   A   A   R   V   L

GAA CTT CTG GGA CAG AGG GGG TGG GAA GCC CTT AAA TAT CTG GGA AGC CTT GTG CAG TAT TGG GGT CTA GAG CTA
        C   C T     C T T               G   C                   C   T TCG   C   C                       C   C
 E   L   L   G   Q   R   G   W   E   A   L   K   Y   L   G   S   L   V   Q   Y   W   G   L   E   L

AAA AAG AGT GCT ATT AGT CTG CTT GAT ACC ATA GCA ATA GCA GTA GCT GAA GGA ACA GAT AGG ATT ATA GAA TTC
            TCG   G     TCG   C   C             G           G           G   C   G           T   G         C T
 K   K   S   A   I   S   L   L   D   T   I   A   I   A   V   A   E   G   T   D   R   I   I   E   F

ATA CAA AGA ATT TGT AGA GCT ATT CGC AAC ATA CCT AGA AGA ATA AGA CAG GGC TTT GAA GCA GCT TTG CAA TAA
        C T         C T   G             T               GCTCT       C T           T               G GCC
 I   Q   R   I   C   R   A   I   R   N   I   P   R   R   I   R   Q   G   F   E   A   A   L   Q
```

FIG. 22A

```
GTG AAT ATT CAG GCT CTT CTC TCA GAA AAA GTC CGT CAG GCC ATG ATT GCG GCA GGC GCG CCT GCG GAT TGC GAA
                                              A G
 V   N   I   Q   A   L   L   S   E   K   V   R   Q   A   M   I   A   A   G   A   P   A   D   C   E

CCG CAG GTT CGT CAG TCA GCA AAA GTT CAG TTC GGC GAC TAT CAG GCT AAC GGC ATG ATG GCA GTT GCT AAA AAA
            A G
 P   Q   V   R   Q   S   A   K   V   Q   F   G   D   Y   Q   A   N   G   M   M   A   V   A   K   K

CTG GGT ATG GCA CCG CGA CAA TTA GCA GAG CAG GTG CTG ACT CAT CTG GAT CTT AAC GGT ATC GCC AGC AAA GTT
                    A G
 L   G   M   A   P   R   Q   L   A   E   Q   V   L   T   H   L   D   L   N   G   I   A   S   K   V

GAG ATC GCC GGT CCA GGC TTT ATC AAC ATT TTC CTT GAT CCG GCA TTC CTG GCT GAA CAT GTT CAG CAG GCG CTG
 E   I   A   G   P   G   F   I   N   I   F   L   D   P   A   F   L   A   E   H   V   Q   Q   A   L

GCG TCC GAT CGT CTC GGT GTT GCT ACG CCA GAA AAA CAG ACC ATT GTG GTT GAC TAC TCT GCG CCA AAC GTG GCG
            A G
 A   S   D   R   L   G   V   A   T   P   E   K   Q   T   I   V   V   D   Y   S   A   P   N   V   A

AAA GAG ATG CAT GTC GGT CAC CTG CGC TCT ACC ATT ATT GGT GAC GCA GCA GTG CGT ACT CTG GAG TTC CTC GGT
                            A G                                     A G
 K   E   M   H   V   G   H   L   R   S   T   I   I   G   D   A   A   V   R   T   L   E   F   L   G

CAC AAA GTG ATT CGC GCA AAC CAC GTC GGC GAC TGG GGC ACT CAG TTC GGT ATG CTG ATT GCA TGG CTG GAA AAG
                    A G
 H   K   V   I   R   A   N   H   V   G   D   W   G   T   Q   F   G   M   L   I   A   W   L   E   K

CAG CAG CAG GAA AAC GCC GGT GAA ATG GAG CTG GCT GAC CTT GAA GGT TTC TAC CGC GAT GCG AAA AAG CAT TAC
                                                                                A G
 Q   Q   Q   E   N   A   G   E   M   E   L   A   D   L   E   G   F   Y   R   D   A   K   K   H   Y

GAT GAA GAT GAA GAG TTC GCC GAG CGC GCA CGT AAC TAC GTG GTA AAA CTG CAA AGC GGT GAC GAA TAT TTC CGC
                            A G         A G                                                     A G
 D   E   D   E   E   F   A   E   R   A   R   N   Y   V   V   K   L   Q   S   G   D   E   Y   F   R

GAG ATG TGG CGC AAA CTG GTC GAC ATC ACC ATG ACG CAG AAC CAG ATC ACC TAC GAT CGT CTC AAC GTG ACG CTG
                A G                                                         A G
 E   M   W   R   K   L   V   D   I   T   M   T   Q   N   Q   I   T   Y   D   R   L   N   V   T   L

ACC CGT GAT GAC GTG ATG GGC GAA AGC CTC TAC AAC CCG ATG CTG CCA GGA ATT GTG GCG GAT CTC AAA GCC AAA
    A G
 T   R   D   D   V   M   G   E   S   L   Y   N   P   M   L   P   G   I   V   A   D   L   K   A   K

GGT CTG GCA GTA GAA AGC GAA GGG GCG ACC GTC GTA TTC CTT GAT GAG TTT AAA AAC AAG GAA GGC GAA CCG ATG
 G   L   A   V   E   S   E   G   A   T   V   V   F   L   D   E   F   K   N   K   E   G   E   P   M

GGC GTG ATC ATT CAG AAG AAA GAT GGC GGC TAT CTC TAC ACC ACC ACT GAT ATC GCC TGT GCG AAA TAT CGT TAT
                                                                                            A G
 G   V   I   I   Q   K   K   D   G   G   Y   L   Y   T   T   T   D   I   A   C   A   K   Y   R   Y

GAA ACA CTG CAT GCC GAT CGC GTG CTG TAT TAC ATC GAC TCC CGT CAG CAT CAA CAC CTG ATG CAG GCA TGG GCG
                    A G                                     A G
 E   T   L   H   A   D   R   V   L   Y   Y   I   D   S   R   Q   H   Q   H   L   M   Q   A   W   A

ATC GTC CGT AAA GCA GGC TAT GTA CCG GAA TCC GTA CCG CTG GAA CAC CAC ATG TTC GGC ATG ATG CTG GGT AAA
        A G
 I   V   R   K   A   G   Y   V   P   E   S   V   P   L   E   H   H   M   F   G   M   M   L   G   K

GAC GGC AAA CCG TTC AAA ACC CGC GCG GGT GGT ACA GTG AAA CTG GCC GAT CTG CTG GAT GAA GCC CTG GAA CGT
                            A G                                                                 A G
 D   G   K   P   F   K   T   R   A   G   G   T   V   K   L   A   D   L   L   D   E   A   L   E   R

GCA CGC CGT CTG GTG GCA GAA AAG AAC CCG GAT ATG CCA GCC GAC GAG CTG GAA AAA CTG GCT AAC GCG GTT GGT
    A G A G
 A   R   R   L   V   A   E   K   N   P   D   M   P   A   D   E   L   E   K   L   A   N   A   V   G

ATT GGT GCG GTG AAA TAT GCG GAT CTC TCC AAA AAC CGC ACC ACG GAC TAC ATC TTC GAC TGG GAC AAC ATG CTG
                                                    A G
 I   G   A   V   K   Y   A   D   L   S   K   N   R   T   T   D   Y   I   F   D   W   D   N   M   L

GCG TTT GAG GGT AAT ACC GCG CCA TAC ATG CAG TAT GCA TAC ACG CGT GTA TTG TCC GTG TTC CGT AAA GCA GAA
                                                                A G                 A G
 A   F   E   G   N   T   A   P   Y   M   Q   Y   A   Y   T   R   V   L   S   V   F   R   K   A   E

ATT GAC GAA GAG CAA CTG GCT GCA GCT CCG GTT ATC ATC CGT GAA GAT CGT GAA GCG CAA CTG GCA GCT CGC CTG
                                                        A G         A G                         A G
 I   D   E   E   Q   L   A   A   A   P   V   I   I   R   E   D   R   E   A   Q   L   A   A   R   L

CTG CAG TTT GAA GAA ACC CTC ACC GTG GTT GCC CGT GAA GGC ACG CCG CAT GTA ATG TGT GCT TAC CTG TAC GAT
                                                    A G
 L   Q   F   E   E   T   L   T   V   V   A   R   E   G   T   P   H   V   M   C   A   Y   L   Y   D
```

FIG. 22B

```
CTG GCC GGT CTG TTC TCT GGC TTC TAC GAG CAC TGC CCG ATC CTC AGC GCA GAA AAC GAA GAA GTG CGT AAC AGC
                                                                                          A G
 L   A   G   L   F   S   G   F   Y   E   H   C   P   I   L   S   A   E   N   E   E   V   R   N   S

CGT CTA AAA CTG GCA CAA CTG ACG GCG AAG ACG CTG AAG CTG GGT CTG GAT ACG CTG GGT ATT GAG ACT GTA GAG
A G
 R   L   K   L   A   Q   L   T   A   K   T   L   K   L   G   L   D   T   L   G   I   E   T   V   E

CGT ATG TAA
A G
 R   M   *
```

FIG. 23

```
GTG TCT AAA GAA AAA TTT GAA CGT ACA AAA CCG CAC GTT AAC GTT GGT ACT ATC GGC CAC GTT GAC CAC GGT AAA
                                A G
 V   S   K   E   K   F   E   R   T   K   P   H   V   N   V   G   T   I   G   H   V   D   H   G   K
ACT ACT CTG ACC GCT GCA ATC ACC ACC GTA CTG GCT AAA ACC TAC GGT GGT GCT GCT CGT GCA TTC GAC CAG ATC
                                                                                A G
 T   T   L   T   A   A   I   T   T   V   L   A   K   T   Y   G   G   A   A   R   A   F   D   Q   I
GAT AAC GCG CCG GAA GAA AAA GCT CGT GGT ATC ACC ATC AAC ACT TCT CAC GTT GAA TAC GAC ACC CCG ACC CGT
                                A G                                                             A G
 D   N   A   P   E   E   K   A   R   G   I   T   I   N   T   S   H   V   E   Y   D   T   P   T   R
CAC TAC GCA CAC GTA GAC TGC CCG GGG CAC GCC GAC TAT GTT AAA AAC ATG ATC ACC GGT GCT GCT CAG ATG GAC
 H   Y   A   H   V   D   C   P   G   H   A   D   Y   V   K   N   M   I   T   G   A   A   Q   M   D
GGC GCG ATC CTG GTA GTT GCT GCG ACT GAC GGC CCG ATG CCG CAG ACT CGT GAG CAC ATC CTG CTG GGT CGT CAG
                                                                A G                         A G
 G   A   I   L   V   V   A   A   T   D   G   P   M   P   Q   T   R   E   H   I   L   L   G   R   Q
GTA GGC GTT CCG TAC ATC ATC GTG TTC CTG AAC AAA TGC GAC ATG GTT GAT GAC GAA GAG CTG CTG GAA CTG GTT
 V   G   V   P   Y   I   I   V   F   L   N   K   C   D   M   V   D   D   E   E   L   L   E   L   V
GAA ATG GAA GTT CGT GAA CTT CTG TCT CAG TAC GAC TTC CCG GGC GAC GAC ACT CCG ATC GTT CGT GGT TCT GCT
                A G                                                                     A G
 E   M   E   V   R   E   L   L   S   Q   Y   D   F   P   G   D   D   T   P   I   V   R   G   S   A
CTG AAA GCG CTG GAA GGC GAC GCA GAG TGG GAA GCG AAA ATC CTG GAA CTG GCT GGC TTC CTG GAT TCT TAT ATT
 L   K   A   L   E   G   D   A   E   W   E   A   K   I   L   E   L   A   G   F   L   D   S   Y   I
CCG GAA CCA GAG CGT GCG ATT GAC AAG CCG TTC CTG CTG CCG ATC GAA GAC GTA TTC TCC ATC TCC GGT CGT GGT
                    A G                                                                     A G
 P   E   P   E   R   A   I   D   K   P   F   L   L   P   I   E   D   V   F   S   I   S   G   R   G
ACC GTT GTT ACC GGT CGT GTA GAA CGC GGT ATC ATC AAA GTT GGT GAA GAA GTT GAA ATC GTT GGT ATC AAA GAG
                        A G         A G
 T   V   V   T   G   R   V   E   R   G   I   I   K   V   G   E   E   V   E   I   V   G   I   K   E
ACT CAG AAG TCT ACC TGT ACT GGC GTT GAA ATG TTC CGC AAA CTG CTG GAC GAA GGC CGT GCT GGT GAG AAC GTA
                                                    A G                         A G
 T   Q   K   S   T   C   T   G   V   E   M   F   R   K   L   L   D   E   G   R   A   G   E   N   V
GGT GTT CTG CTG CGT GGT ATC AAA CGT GAA GAA ATC GAA CGT GGT CAG GTA CTG GCT AAG CCG GGC ACC ATC AAG
                    A G                 A G                 A G
 G   V   L   L   R   G   I   K   R   E   E   I   E   R   G   Q   V   L   A   K   P   G   T   I   K
CCG CAC ACC AAG TTC GAA TCT GAA GTG TAC ATT CTG TCC AAA GAT GAA GGC GGC CGT CAT ACT CCG TTC TTC AAA
                                                                            A G
 P   H   T   K   F   E   S   E   V   Y   I   L   S   K   D   E   G   G   R   H   T   P   F   F   K
GGC TAC CGT CCG CAG TTC TAC TTC CGT ACT ACT GAC GTG ACT GGT ACC ATC GAA CTG CCG GAA GGC GTA GAG ATG
            A G             A G
 G   Y   R   P   Q   F   Y   F   R   T   T   D   V   T   G   T   I   E   L   P   E   G   V   E   M
GTA ATG CCG GGC GAC AAC ATC AAA ATG GTT GTT ACC CTG ATC CAC CCG ATC GCG ATG GAC GAC GGT CTG CGT TTC
                                                                                        A G
 V   M   P   G   D   N   I   K   M   V   V   T   L   I   H   P   I   A   M   D   D   G   L   R   F
GCA ATC CGT GAA GGC GGC CGT ACC GTT GGC GCG GGC GTT GTT GCT AAA GTT CTG GGC TAA
        A G             A G
 A   I   R   E   G   G   R   T   V   G   A   G   V   V   A   K   V   L   G   *
```

Codon usage table                                                                                          Page 1 of 1

*Foot-and-mouth disease virus* [gbvrl]: 15 CDS's (19368 codons)

fields: [triplet] [frequency: per thousand] ([number])

```
UUU 20.6( 399)  UCU  6.2( 121)  UAU  4.9(  94)  UGU  6.1( 119)
UUC 25.6( 495)  UCC 14.8( 287)  UAC 30.7( 595)  UGC  8.4( 162)
UUA  1.3(  25)  UCA  8.9( 172)  UAA  0.4(   8)  UGA  0.0(   0)
UUG 16.7( 323)  UCG  8.0( 154)  UAG  0.1(   1)  UGG 10.1( 196)

CUU 17.5( 339)  CCU 14.6( 282)  CAU  2.4(  47)  CGU  6.7( 130)
CUC 25.5( 494)  CCC 16.5( 320)  CAC 25.0( 485)  CGC 12.7( 246)
CUA  2.9(  57)  CCA 11.6( 225)  CAA 14.5( 280)  CGA  1.7(  33)
CUG 20.5( 397)  CCG 12.5( 243)  CAG 18.7( 362)  CGG  6.5( 125)

AUU 17.0( 329)  ACU 16.4( 317)  AAU  5.9( 115)  AGU  6.6( 127)
AUC 24.4( 473)  ACC 28.5( 552)  AAC 36.8( 713)  AGC  9.7( 187)
AUA  3.2(  62)  ACA 16.4( 318)  AAA 26.8( 520)  AGA 12.3( 238)
AUG 25.2( 488)  ACG  9.7( 187)  AAG 34.1( 660)  AGG  7.2( 139)

GUU 17.8( 345)  GCU 19.7( 381)  GAU 13.4( 259)  GGU 17.3( 335)
GUC 21.2( 411)  GCC 31.3( 606)  GAC 47.8( 925)  GGC 20.8( 402)
GUA  5.0(  96)  GCA 21.3( 413)  GAA 18.1( 351)  GGA 16.3( 316)
GUG 33.3( 644)  GCG 13.8( 267)  GAG 37.1( 718)  GGG 13.3( 258)
```

Coding GC 53.64% 1st letter GC 55.72% 2nd letter GC 40.57% 3rd letter GC 64.62%

Format:
[SELECT A CODE] Genetic codes (NCBI)
● Codon Usage Table with Amino Acids
○ A style like CodonFrequency output in GCG Wisconsin Package™
[Submit]

CDS Search:
[_____] [Submit]
Keyword example: ribosomal protein / MAP kinase List of codon usage for each CDS (format)

*Homepage*

FIG. 24A

Codon usage table                                                                 Page 1 of 1

*SARS coronavirus* [gbvrl]: 1 CDS's (423 codons)

fields: [triplet] [frequency: per thousand] ([number])

| | | | | | | | |
|---|---|---|---|---|---|---|---|
| UUU 9.5( | 4) | UCU 23.6( | 10) | UAU 4.7( | 2) | UGU 0.0( | 0) |
| UUC 21.3( | 9) | UCC 7.1( | 3) | UAC 21.3( | 9) | UGC 0.0( | 0) |
| UUA 2.4( | 1) | UCA 21.3( | 9) | UAA 2.4( | 1) | UGA 0.0( | 0) |
| UUG 14.2( | 6) | UCG 2.4( | 1) | UAG 0.0( | 0) | UGG 11.8( | 5) |
| CUU 16.5( | 7) | CCU 23.6( | 10) | CAU 7.1( | 3) | CGU 11.8( | 5) |
| CUC 7.1( | 3) | CCC 21.3( | 9) | CAC 4.7( | 2) | CGC 18.9( | 8) |
| CUA 11.8( | 5) | CCA 23.6( | 10) | CAA 56.7( | 24) | CGA 14.2( | 6) |
| CUG 9.5( | 4) | CCG 4.7( | 2) | CAG 23.6( | 10) | CGG 0.0( | 0) |
| AUU 18.9( | 8) | ACU 37.8( | 16) | AAU 37.8( | 16) | AGU 16.5( | 7) |
| AUC 7.1( | 3) | ACC 11.8( | 5) | AAC 21.3( | 9) | AGC 11.8( | 5) |
| AUA 2.4( | 1) | ACA 26.0( | 11) | AAA 47.3( | 20) | AGA 23.6( | 10) |
| AUG 16.5( | 7) | ACG 0.0( | 0) | AAG 21.3( | 9) | AGG 4.7( | 2) |
| GUU 9.5( | 4) | GCU 33.1( | 14) | GAU 23.6( | 10) | GGU 23.6( | 10) |
| GUC 9.5( | 4) | GCC 18.9( | 8) | GAC 28.4( | 12) | GGC 37.8( | 16) |
| GUA 2.4( | 1) | GCA 21.3( | 9) | GAA 16.5( | 7) | GGA 37.8( | 16) |
| GUG 4.7( | 2) | GCG 7.1( | 3) | GAG 16.5( | 7) | GGG 7.1( | 3) |

Coding GC 48.31% 1st letter GC 55.32% 2nd letter GC 50.35% 3rd letter GC 39.24%

Format:
[SELECT A CODE]    Genetic codes (NCBI)
● Codon Usage Table with Amino Acids
○ A style like CodonFrequency output in GCG Wisconsin Package™
[Submit]

CDS Search:
[_____] [Submit]
Keyword example: ribosomal protein / MAP kinase List of codon usage for each CDS (format)

*Homepage*

FIG. 24B

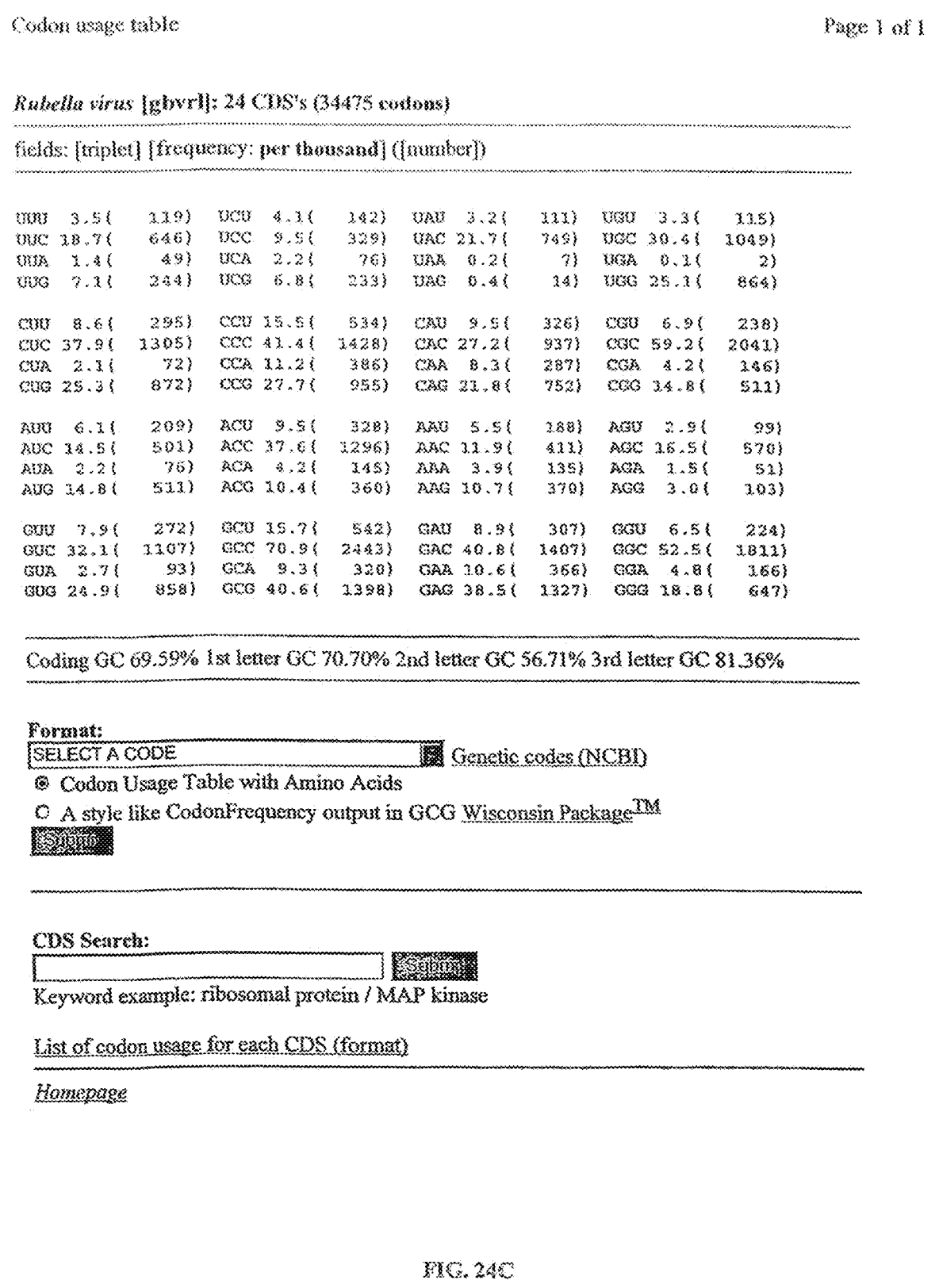

*Rubella virus* [gbvrl]: 24 CDS's (34475 codons)

fields: [triplet] [frequency: per thousand] ([number])

| | | | |
|---|---|---|---|
| UUU 3.5( 119) | UCU 4.1( 142) | UAU 3.2( 111) | UGU 3.3( 115) |
| UUC 18.7( 646) | UCC 9.5( 329) | UAC 21.7( 749) | UGC 30.4( 1049) |
| UUA 1.4( 49) | UCA 2.2( 76) | UAA 0.2( 7) | UGA 0.1( 2) |
| UUG 7.1( 244) | UCG 6.8( 233) | UAG 0.4( 14) | UGG 25.1( 864) |
| CUU 8.6( 295) | CCU 15.5( 534) | CAU 9.5( 326) | CGU 6.9( 238) |
| CUC 37.9( 1305) | CCC 41.4( 1428) | CAC 27.2( 937) | CGC 59.2( 2041) |
| CUA 2.1( 72) | CCA 11.2( 386) | CAA 8.3( 287) | CGA 4.2( 146) |
| CUG 25.3( 872) | CCG 27.7( 955) | CAG 21.8( 752) | CGG 14.8( 511) |
| AUU 6.1( 209) | ACU 9.5( 328) | AAU 5.5( 188) | AGU 2.9( 99) |
| AUC 14.5( 501) | ACC 37.6( 1296) | AAC 11.9( 411) | AGC 16.5( 570) |
| AUA 2.2( 76) | ACA 4.2( 145) | AAA 3.9( 135) | AGA 1.5( 51) |
| AUG 14.8( 511) | ACG 10.4( 360) | AAG 10.7( 370) | AGG 3.0( 103) |
| GUU 7.9( 272) | GCU 15.7( 542) | GAU 8.9( 307) | GGU 6.5( 224) |
| GUC 32.1( 1107) | GCC 70.9( 2443) | GAC 40.8( 1407) | GGC 52.5( 1811) |
| GUA 2.7( 93) | GCA 9.3( 320) | GAA 10.6( 366) | GGA 4.8( 166) |
| GUG 24.9( 858) | GCG 40.6( 1398) | GAG 38.5( 1327) | GGG 18.8( 647) |

Coding GC 69.59% 1st letter GC 70.70% 2nd letter GC 56.71% 3rd letter GC 81.36%

Format:
SELECT A CODE Genetic codes (NCBI)
◉ Codon Usage Table with Amino Acids
○ A style like CodonFrequency output in GCG Wisconsin Package™
Submit

CDS Search:
Submit
Keyword example: ribosomal protein / MAP kinase

List of codon usage for each CDS (format)

*Homepage*

FIG. 24C

Codon usage table                                                                 Page 1 of 1

*Dengue virus type 1* [gbvrl]: 33 CDS's (106280 codons)

fields: [triplet] [frequency: per thousand] ([number])

```
UUU 15.0( 1598)  UCU  9.1(  962)  UAU 10.9( 1160)  UGU  9.1(  965)
UUC 16.4( 1739)  UCC  9.8( 1038)  UAC 10.4( 1106)  UGC  8.4(  889)
UUA 12.1( 1288)  UCA 22.0( 2338)  UAA  0.2(   25)  UGA  0.1(    6)
UUG 18.7( 1992)  UCG  3.1(  329)  UAG  0.0(    0)  UGG 28.2( 2997)

CUU 10.4( 1110)  CCU  6.3(  672)  CAU  9.9( 1052)  CGU  3.0(  316)
CUC 11.0( 1170)  CCC  8.1(  856)  CAC 11.1( 1179)  CGC  3.7(  394)
CUA 19.6( 2079)  CCA 23.1( 2457)  CAA 18.6( 1972)  CGA  4.8(  510)
CUG 22.3( 2369)  CCG  3.7(  391)  CAG 13.8( 1463)  CGG  2.7(  291)

AUU 15.5( 1644)  ACU 14.4( 1535)  AAU 17.1( 1817)  AGU  7.6(  811)
AUC 16.0( 1696)  ACC 17.3( 1835)  AAC 19.8( 2104)  AGC  8.1(  859)
AUA 26.8( 2851)  ACA 34.6( 3682)  AAA 40.5( 4303)  AGA 29.5( 3132)
AUG 37.4( 3979)  ACG 10.1( 1078)  AAG 20.0( 2126)  AGG 12.8( 1359)

GUU 14.7( 1564)  GCU 16.2( 1720)  GAU 18.3( 1941)  GGU 10.1( 1074)
GUC 13.3( 1415)  GCC 32.9( 3434)  GAC 24.2( 2577)  GGC 11.0( 1172)
GUA  9.6( 1020)  GCA 23.3( 2481)  GAA 38.9( 4135)  GGA 48.0( 5103)
GUG 29.6( 3144)  GCG  7.2(  765)  GAG 26.2( 2782)  GGG 13.4( 1429)
```

Coding GC 46.38% 1st letter GC 49.90% 2nd letter GC 43.17% 3rd letter GC 46.06%

Format:
[SELECT A CODE ▼]  Genetic codes (NCBI)
● Codon Usage Table with Amino Acids
○ A style like CodonFrequency output in GCG Wisconsin Package™
[Submit]

CDS Search:
[_____] [Submit]
Keyword example: ribosomal protein / MAP kinase List of codon usage for each CDS (format)

*Homepage*

FIG. 24D

Codon usage table                                                                 Page 1 of 1

*Dengue virus type 2* [gbvrl]: 64 CDS's (177008 codons)

fields: [triplet] [frequency: per thousand] ([number])

```
UUU 13.2( 2339)  UCU  7.9( 1405)  UAU  8.6( 1516)  UGU  7.7( 1362)
UUC 16.3( 2886)  UCC  8.7( 1543)  UAC 12.6( 2237)  UGC  9.5( 1678)
UUA 10.6( 1870)  UCA 19.4( 3426)  UAA  0.0(    0)  UGA  0.0(    0)
UUG 17.9( 3172)  UCG  2.7(  485)  UAG  0.3(   51)  UGG 26.8( 4746)

CUU  9.5( 1690)  CCU  7.2( 1283)  CAU 10.8( 1917)  CGU  3.7(  663)
CUC 14.6( 2588)  CCC  8.0( 1420)  CAC  9.0( 1597)  CGC  3.6(  636)
CUA 16.6( 2942)  CCA 25.0( 4432)  CAA 18.7( 3309)  CGA  4.0(  708)
CUG 23.0( 4066)  CCG  2.8(  468)  CAG 11.4( 2017)  CGG  2.1(  380)

AUU 16.9( 2988)  ACU 12.2( 2157)  AAU 19.0( 3362)  AGU  8.9( 1583)
AUC 23.1( 4095)  ACC 16.4( 2896)  AAC 21.4( 3796)  AGC  9.1( 1614)
AUA 24.9( 4412)  ACA 39.6( 7008)  AAA 41.7( 7377)  AGA 32.4( 5743)
AUG 37.3( 6598)  ACG  9.7( 1725)  AAG 22.8( 4029)  AGG 10.8( 1914)

GUU 13.7( 2423)  GCU 15.3( 2714)  GAU 16.6( 2931)  GGU  8.9( 1569)
GUC 14.1( 2497)  GCC 20.2( 3569)  GAC 22.6( 4006)  GGC 11.3( 1993)
GUA  9.1( 1606)  GCA 25.6( 4529)  GAA 49.9( 8826)  GGA 45.8( 8114)
GUG 26.6( 4708)  GCG  5.5(  971)  GAG 21.5( 3797)  GGG 14.7( 2606)
```

Coding GC 45.79% 1st letter GC 49.15% 2nd letter GC 42.57% 3rd letter GC 45.65%

Format:
[SELECT A CODE] ▣ Genetic codes (NCBI)
⦿ Codon Usage Table with Amino Acids
○ A style like CodonFrequency output in GCG Wisconsin Package™
[Submit]

CDS Search:
[_____] [Submit]
Keyword example: ribosomal protein / MAP kinase List of codon usage for each CDS (format)

*Homepage*

FIG. 24E

Codon usage table                                                         Page 1 of 1

*Human herpesvirus 3* [gbvrl]: 362 CDS's (282525 codons)

fields: [triplet] [frequency: per thousand] ([number])

```
UUU 32.7( 6627)  UCU 14.6( 2950)  UAU 20.3( 4117)  UGU 13.0( 2626)
UUC  6.5( 1322)  UCC 14.9( 3026)  UAC 14.1( 2848)  UGC  5.7( 1145)
UUA 26.6( 5394)  UCA 12.2( 2469)  UAA  1.1(  220)  UGA  0.4(   84)
UUG 17.0( 3437)  UCG 13.8( 2798)  UAG  0.3(   57)  UGG 11.0( 2227)

CUU 18.1( 3661)  CCU 11.0( 2235)  CAU 16.0( 3240)  CGU 13.8( 2787)
CUC  8.1( 1632)  CCC 19.2( 3885)  CAC 11.4( 2317)  CGC 11.8( 2385)
CUA  9.7( 1955)  CCA 17.9( 3634)  CAA 20.5( 4148)  CGA 11.8( 2387)
CUG 13.4( 2715)  CCG 16.5( 3332)  CAG 13.7( 2776)  CGG 11.9( 2411)

AUU 24.1( 4880)  ACU 11.4( 2316)  AAU 20.6( 4165)  AGU  9.1( 1849)
AUC 11.0( 2236)  ACC 19.3( 3908)  AAC 18.4( 3730)  AGC 10.2( 2070)
AUA 18.0( 3648)  ACA 22.4( 4542)  AAA 23.3( 4723)  AGA 10.3( 2085)
AUG 20.2( 4099)  ACG 17.7( 3593)  AAG 11.9( 2403)  AGG  5.9( 1197)

GUU 22.6( 4571)  GCU 14.0( 2845)  GAU 31.7( 6416)  GGU 14.3( 2905)
GUC  9.6( 1951)  GCC 23.6( 4771)  GAC 22.8( 4612)  GGC  9.9( 2013)
GUA 19.2( 3887)  GCA 19.6( 3963)  GAA 30.8( 6241)  GGA 23.6( 4788)
GUG 18.2( 3688)  GCG 19.7( 3985)  GAG 21.1( 4271)  GGG 16.4( 3327)
```

Coding GC 47.80% 1st letter GC 54.18% 2nd letter GC 44.70% 3rd letter GC 44.52%

Format:
[SELECT A CODE] Genetic codes (NCBI)
● Codon Usage Table with Amino Acids
○ A style like CodonFrequency output in GCG Wisconsin Package™
[Submit]

CDS Search:
[_____] [Submit]
Keyword example: ribosomal protein / MAP kinase List of codon usage for each CDS (format)

*Homepage*

FIG. 24F

Codon usage table                                                         Page 1 of 1

*Human herpesvirus 5* [gbvrl]: 1750 CDS's (528829 codons)

fields: [triplet] [frequency: per thousand] ([number])

```
UUU 21.8( 11529)   UCU 10.9(  5775)   UAU 11.0(  5805)   UGU 12.4(  6552)
UUC 18.3(  9694)   UCC 16.5(  8747)   UAC 25.4( 13436)   UGC 16.9(  8914)
UUA  7.9(  4193)   UCA  7.7(  4058)   UAA  1.3(   704)   UGA  1.5(   814)
UUG 14.9(  7860)   UCG 19.0( 10024)   UAG  0.4(   230)   UGG 15.2(  8046)

CUU  9.5(  5028)   CCU  8.5(  4493)   CAU  9.6(  5078)   CGU 14.9(  7857)
CUC 21.0( 11126)   CCC 18.8(  9963)   CAC 19.8( 10470)   CGC 24.6( 12996)
CUA  9.5(  5038)   CCA  6.7(  3564)   CAA 12.3(  6505)   CGA  8.7(  4598)
CUG 36.6( 19332)   CCG 20.7( 10946)   CAG 21.6( 11408)   CGG 13.5(  7151)

AUU 10.7(  5655)   ACU 13.8(  7278)   AAU 11.6(  6149)   AGU  9.8(  5177)
AUC 21.6( 11402)   ACC 26.1( 13798)   AAC 24.2( 12794)   AGC 19.3( 10213)
AUA  5.7(  3034)   ACA 12.7(  6715)   AAA 15.9(  8430)   AGA  5.8(  3044)
AUG 22.5( 11885)   ACG 26.2( 13869)   AAG 16.3(  8610)   AGG  3.4(  1794)

GUU 10.5(  5575)   GCU 12.0(  6371)   GAU 15.1(  7990)   GGU 13.9(  7344)
GUC 18.4(  9727)   GCC 30.2( 15955)   GAC 30.7( 16253)   GGC 25.6( 13528)
GUA 12.0(  6370)   GCA  7.9(  4199)   GAA 18.7(  9905)   GGA  8.7(  4587)
GUG 35.2( 18637)   GCG 21.5( 11383)   GAG 28.6( 15109)   GGG  7.8(  4115)
```

Coding GC 55.84% 1st letter GC 55.33% 2nd letter GC 46.11% 3rd letter GC 66.07%

Format:
[SELECT A CODE]    Genetic codes (NCBI)
◉ Codon Usage Table with Amino Acids
○ A style like CodonFrequency output in GCG Wisconsin Package™
[Submit]

CDS Search:
[_____] [Submit]
Keyword example: ribosomal protein / MAP kinase List of codon usage for each CDS [CAUTION: The file is big (> 1000 entries).] (format)

*Homepage*

FIG. 24G

Codon usage table                                                                 Page 1 of 1

*Herpes simplex virus 1 strain R-15* [gbvrl]: 17 CDS's (2826 codons)

fields: [triplet] [frequency: per thousand] ([number])

```
UUU 10.6(    30)  UCU  9.6(    27)  UAU  7.1(    20)  UGU  7.4(    21)
UUC  8.1(    23)  UCC 27.2(    77)  UAC  6.4(    18)  UGC 11.3(    32)
UUA  2.1(     6)  UCA  4.6(    13)  UAA  2.8(     8)  UGA  1.8(     5)
UUG  9.6(    27)  UCG 25.5(    72)  UAG  1.4(     4)  UGG 19.5(    55)

CUU  8.8(    25)  CCU 12.7(    36)  CAU  8.1(    23)  CGU 14.5(    41)
CUC 13.8(    39)  CCC 53.4(   151)  CAC 16.6(    47)  CGC 40.7(   115)
CUA  3.2(     9)  CCA 21.2(    60)  CAA 11.0(    31)  CGA 14.9(    42)
CUG 16.3(    46)  CCG 40.7(   115)  CAG 18.0(    51)  CGG 48.5(   137)

AUU  5.7(    16)  ACU  5.0(    14)  AAU  4.2(    12)  AGU  6.7(    19)
AUC  6.0(    17)  ACC 18.0(    51)  AAC 10.6(    30)  AGC 12.4(    35)
AUA  6.7(    19)  ACA  9.9(    28)  AAA  9.9(    28)  AGA  8.8(    25)
AUG 17.7(    50)  ACG 20.2(    57)  AAG  9.2(    26)  AGG 12.7(    36)

GUU  9.2(    26)  GCU 13.1(    37)  GAU 11.0(    31)  GGU 16.3(    46)
GUC 15.9(    45)  GCC 39.3(   111)  GAC 15.6(    44)  GGC 37.2(   105)
GUA  9.2(    26)  GCA 14.5(    41)  GAA  9.2(    26)  GGA 16.6(    47)
GUG 17.3(    49)  GCG 38.6(   109)  GAG 15.9(    45)  GGG 59.8(   169)
```

Coding GC 68.91% 1st letter GC 68.12% 2nd letter GC 68.26% 3rd letter GC 70.35%

Format:
[SELECT A CODE]  Genetic codes (NCBI)
● Codon Usage Table with Amino Acids
○ A style like CodonFrequency output in GCG Wisconsin Package™
[Submit]

CDS Search:
[                    ] [Submit]
Keyword example: ribosomal protein / MAP kinase List of codon usage for each CDS (format)

*Homepage*

FIG. 24H

Codon usage table                                                          Page 1 of 1

*Respiratory syncytial virus* [gbvrl]: 98 CDS's (13114 codons)

fields: [triplet] [frequency: per thousand] ([number])

```
UUU 20.7(  272)  UCU 13.7(  180)  UAU 20.0(  262)  UGU  9.4(  123)
UUC 22.8(  299)  UCC 19.1(  250)  UAC  9.2(  120)  UGC  7.2(   94)
UUA 25.2(  330)  UCA 17.5(  229)  UAA  0.5(    6)  UGA  0.8(   10)
UUG  9.7(  127)  UCG  2.3(   27)  UAG  6.2(   81)  UGG 10.0(  131)

CUU 11.2(  147)  CCU 10.1(  132)  CAU 17.7(  232)  CGU  1.0(   13)
CUC  9.7(  127)  CCC 14.0(  183)  CAC  9.1(  119)  CGC  2.1(   28)
CUA 35.3(  463)  CCA 20.3(  266)  CAA 27.8(  365)  CGA  2.8(   37)
CUG  4.4(   58)  CCG  1.0(   13)  CAG  6.9(   91)  CGG  0.4(    5)

AUU 23.0(  301)  ACU 24.3(  319)  AAU 39.0(  511)  AGU 13.8(  181)
AUC 41.3(  541)  ACC 30.0(  393)  AAC 32.4(  425)  AGC 14.0(  183)
AUA 56.4(  740)  ACA 73.3(  961)  AAA 59.3(  778)  AGA 12.8(  168)
AUG 31.6(  415)  ACG  1.6(   21)  AAG 20.0(  262)  AGG  3.1(   40)

GUU  7.2(   95)  GCU  9.0(  118)  GAU 16.2(  212)  GGU  4.4(   58)
GUC  7.7(  101)  GCC  6.0(   79)  GAC  6.6(   86)  GGC  3.7(   49)
GUA  9.9(  130)  GCA 18.2(  239)  GAA 38.6(  506)  GGA 13.6(  178)
GUG  5.2(   68)  GCG  0.4(    5)  GAG  8.1(  106)  GGG  1.9(   25)
```

Coding GC 34.63% 1st letter GC 33.05% 2nd letter GC 36.13% 3rd letter GC 34.71%

Format:
[SELECT A CODE]  Genetic codes (NCBI)
● Codon Usage Table with Amino Acids
○ A style like CodonFrequency output in GCG Wisconsin Package™
[Submit]

CDS Search:
[          ] [Submit]
Keyword example: ribosomal protein / MAP kinase List of codon usage for each CDS (format)

*Homepage*

FIG. 24I

Codon usage table                                                                        Page 1 of 1

*Human immunodeficiency virus 1* [gbvrl]: 10515 CDS's (2807118 codons)

fields: [triplet] [frequency: per thousand] ([number])

```
UUU 16.8( 47240)   UCU  7.4( 20658)   UAU 17.2( 48287)   UGU 14.4( 40341)
UUC 10.5( 29601)   UCC  4.7( 13265)   UAC 10.4( 29172)   UGC  7.5( 21110)
UUA 22.7( 63777)   UCA 10.6( 29853)   UAA  1.2(  3269)   UGA  1.0(  2939)
UUG 13.6( 38227)   UCG  1.7(  4757)   UAG  1.5(  4271)   UGG 30.2( 84680)

CUU 10.3( 28961)   CCU 15.5( 43438)   CAU 17.2( 48208)   CGU  0.9(  2638)
CUC  8.3( 23201)   CCC  7.8( 21851)   CAC  9.8( 27638)   CGC  2.1(  5833)
CUA 15.8( 44337)   CCA 24.3( 68143)   CAA 26.9( 75447)   CGA  5.2( 14549)
CUG 16.4( 46165)   CCG  3.7( 10305)   CAG 22.9( 64143)   CGG  2.0(  5493)

AUU 18.0( 50437)   ACU 14.6( 41108)   AAU 33.0( 92660)   AGU 15.9( 44586)
AUC 11.5( 32356)   ACC 11.8( 33092)   AAC 18.8( 52825)   AGC 15.7( 44157)
AUA 33.3( 93573)   ACA 28.9( 81034)   AAA 32.6( 91631)   AGA 39.7(111332)
AUG 22.3( 62475)   ACG  2.8(  7961)   AAG 24.4( 68630)   AGG 17.1( 48026)

GUU  8.3( 23274)   GCU 16.0( 44977)   GAU 22.2( 62426)   GGU  7.9( 22232)
GUC  7.8( 22008)   GCC 10.7( 30005)   GAC 17.9( 50138)   GGC 10.5( 29599)
GUA 27.5( 77207)   GCA 29.4( 82403)   GAA 42.6(120189)   GGA 34.3( 96216)
GUG 14.8( 41645)   GCG  3.9( 10925)   GAG 25.4( 71376)   GGG 19.5( 54818)
```

Coding GC 43.13% 1st letter GC 48.80% 2nd letter GC 41.76% 3rd letter GC 38.82%

Format:
[SELECT A CODE] Genetic codes (NCBI)
● Codon Usage Table with Amino Acids
○ A style like CodonFrequency output in GCG Wisconsin Package™
[Submit]

CDS Search:
[_____] [Submit]
Keyword example: ribosomal protein / MAP kinase List of codon usage for each CDS [CAUTION: The file is big (> 1000 entries).] (format)

*Homepage*

FIG. 24K

Codon usage table   Page 1 of 1

*Equine infectious anemia virus* [gbvrl]: 114 CDS's (61826 codons)

fields: [triplet] [frequency: per thousand] ([number])

```
UUU 22.4( 1384)  UCU 17.2( 1063)  UAU 28.0( 1731)  UGU 19.1( 1181)
UUC  8.3(  512)  UCC 10.5(  648)  UAC  6.8(  419)  UGC  8.9(  553)
UUA 28.8( 1781)  UCA 12.4(  767)  UAA  0.7(   42)  UGA  0.9(   55)
UUG  9.9(  614)  UCG  3.7(  229)  UAG  1.0(   61)  UGG 25.6( 1584)

CUU  8.6(  529)  CCU 20.3( 1258)  CAU 18.5( 1145)  CGU  3.8(  235)
CUC  6.5(  402)  CCC  3.9(  242)  CAC  6.6(  410)  CGC  1.8(  114)
CUA 11.8(  728)  CCA 14.0(  868)  CAA 34.8( 2149)  CGA  4.5(  278)
CUG 10.9(  675)  CCG  1.3(   81)  CAG 16.8( 1039)  CGG  3.0(  185)

AUU 26.3( 1627)  ACU 21.6( 1333)  AAU 49.0( 3027)  AGU 14.8(  913)
AUC 13.9(  858)  ACC  9.2(  569)  AAC 23.2( 1436)  AGC  8.8(  547)
AUA 40.5( 2502)  ACA 24.5( 1516)  AAA 33.3( 2056)  AGA 25.1( 1549)
AUG 22.0( 1363)  ACG  2.6(  163)  AAG 26.2( 1617)  AGG 12.5(  771)

GUU 10.1(  625)  GCU 21.6( 1334)  GAU 20.9( 1293)  GGU  9.1(  560)
GUC  2.8(  176)  GCC  5.2(  323)  GAC 13.8(  852)  GGC 10.7(  664)
GUA 24.3( 1501)  GCA 20.1( 1243)  GAA 42.7( 2639)  GGA 36.1( 2231)
GUG  9.2(  571)  GCG  3.0(  183)  GAG 24.4( 1511)  GGG 21.2( 1311)
```

Coding GC 39.14% 1st letter GC 44.25% 2nd letter GC 39.71% 3rd letter GC 33.45%

Format:
[SELECT A CODE] Genetic codes (NCBI)
● Codon Usage Table with Amino Acids
○ A style like CodonFrequency output in GCG Wisconsin Package™
[Submit]

CDS Search:
[      ] [Submit]
Keyword example: ribosomal protein / MAP kinase

List of codon usage for each CDS (format)

*Homepage*

FIG. 24L

Codon usage table                                                              Page 1 of 1

*Escherichia coli* [gbbct]: 13200 CDS's (4030266 codons)

fields: [triplet] [frequency: per thousand] ([number])

```
UUU 22.3( 89985)   UCU 10.6( 43728)   UAU 18.0( 72440)   UGU  5.3( 21431)
UUC 15.8( 63684)   UCC  9.4( 37738)   UAC 12.1( 48758)   UGC  6.0( 24208)
UUA 14.5( 58346)   UCA  9.7( 38904)   UAA  2.0(  7907)   UGA  1.0(  4206)
UUG 12.7( 51140)   UCG  8.5( 34448)   UAG  0.3(  1149)   UGG 13.9( 55921)

CUU 12.3( 49607)   CCU  7.8( 31303)   CAU 12.5( 50496)   CGU 19.3( 77801)
CUC 10.1( 40777)   CCC  5.5( 22191)   CAC  9.0( 36460)   CGC 18.8( 75701)
CUA  4.4( 17639)   CCA  8.6( 34744)   CAA 14.3( 57536)   CGA  4.0( 16167)
CUG 46.9(189204)   CCG 19.8( 79918)   CAG 28.4(114518)   CGG  6.4( 25766)

AUU 29.5(118960)   ACU 10.9( 43846)   AAU 21.8( 87884)   AGU 10.5( 42329)
AUC 23.0( 92826)   ACC 21.7( 87349)   AAC 21.4( 86073)   AGC 15.0( 60556)
AUA  7.8( 31326)   ACA 10.3( 41555)   AAA 35.1(141491)   AGA  4.2( 16943)
AUG 26.0(104652)   ACG 13.8( 55504)   AAG 12.9( 51895)   AGG  2.5( 10033)

GUU 20.0( 80574)   GCU 17.4( 70044)   GAU 32.8(132131)   GGU 25.2(101534)
GUC 14.2( 57354)   GCC 24.0( 96703)   GAC 19.1( 76987)   GGC 26.2(105620)
GUA 11.8( 47387)   GCA 21.5( 86585)   GAA 38.1(153370)   GGA 10.4( 41743)
GUG 23.7( 95593)   GCG 28.6(115274)   GAG 18.8( 75654)   GGG 11.6( 46760)
```

Coding GC 50.20%  1st letter GC 57.14%  2nd letter GC 40.85%  3rd letter GC 52.61%

Format:
[SELECT A CODE]  Genetic codes (NCBI)
● Codon Usage Table with Amino Acids
○ A style like CodonFrequency output in GCG Wisconsin Package™
[Submit]

CDS Search:
[       ] [Submit]
Keyword example: ribosomal protein / MAP kinase List of codon usage for each CDS [CAUTION: The file is big (> 1000 entries).] (format)

*Homepage*

```
2614 ACA GCC GTG GAG ACA GGG GCT ACC AAT CCG TTG GTG CCT TCG GAC ACC GTG CAA ACG CGC CAT GTC ATC 2682
        G                   A              A       T           T A A
     T  A  V  E  T  G  A  T  N  P  L  V  P  S  D  T  V  Q  T  R  H  V  I
2683 CAG AGA CGA ACG CGA TCA GAG TCC ACG GTT GAG TCA TTC TTT GCA AGA GGG GCT TGC GTG GCT ATC ATT 2751
         A   T  A           T                                          T
     Q  R  R  T  R  S  E  S  T  V  E  S  F  F  A  R  G  A  C  V  A  I  I
2752 GAG GTG GAC AAT GAT GCA CCG ACA AAG CGC GCC AGC AGA TTG TTT TCG GTT TGG AAA ATA ACT TAC AAA 2820
                         A           A A                      A
     E  V  D  N  D  A  P  T  K  R  A  S  R  L  F  S  V  W  K  I  T  Y  K
2821 GAT ACT GTT CAA CTG AGA CGC AAA CTG GAA TTT TTC ACA TAT TCG AGA TTT GAC ATG GAG TTC ACT TTT 2889
                              A A                      A
     D  T  V  Q  L  R  R  K  L  E  F  F  T  Y  S  R  F  D  M  E  F  T  F
2890 GTG GTC ACC TCA AAC TAC ATT GAT GCA AAT AAC GGA CAT GCA TTG AAC CAA GTT TAT CAG ATA ATG TAT 2958
                                         T
     V  V  T  S  N  Y  I  D  A  N  N  G  H  A  L  N  Q  V  Y  Q  I  M  Y
2959 ATA CCA CCC GGA GCA CCT ATC CCT GGT AAA TGG AAT GAC TAT ACG TGG CAG ACG TCC TCT AAC CCG TCG 3027
                 A                              T        T              A  A
     I  P  P  G  A  P  I  P  G  K  W  N  D  Y  T  W  Q  T  S  S  N  P  S
3028 GTG TTT TAC ACC TAT GGG GCG CCC CCA GCA AGA ATA TCA GTG CCC TAC GTG GGA ATT GCT AAT GCG TAT 3096
                         A                            T                       A
     V  F  Y  T  Y  G  A  P  P  A  R  I  S  V  P  Y  V  G  I  A  N  A  Y
3097 TCC CAC TTT TAT GAT GGG TTT GCA AAA GTA CCA CTA GCG GGT CAA GCC TCA ACT GAA GGC GAT TCG TTG 3165
                                                                              T     A
     S  H  F  Y  D  G  F  A  K  V  P  L  A  G  Q  A  S  T  E  G  D  S  L
3166 TAC GGT GCT GCC TCA CTG AAT GAT TTT GGA TCA CTG GCT GTT CGC GTG GTA AAT GAT CAC AAC CCC ACG 3234
     T                                                   A A                             T
     Y  G  A  A  S  L  N  D  F  G  S  L  A  V  R  V  V  N  D  H  N  P  T
3235 CGG CTC ACC TCC AAG ATC AGA GTG TAC ATG AAG CCA AAG CAT GTC AGA GTC TGG TGC CCA CGA CCT CCA 3303
     A                                                                           A       T
     R  L  T  S  K  I  R  V  Y  M  K  P  K  H  V  R  V  W  C  P  R  P  P
```

FIG. 26

```
2614 ACA GCC GTG GAG ACA GGG GCT ACC AAT CCG TTG GTG CCT TCG GAC ACC GTG CAA ACG CGC CAT GTC ATC 2682
        G                   A              A       T           A A A
     T  A  V  E  T  G  A  T  N  P  L  V  P  S  D  T  V  Q  T  R  H  V  I
2683 CAG AGA CGA ACG CGA TCA GAG TCC ACG GTT GAG TCA TTC TTT GCA AGA GGG GCT TGC GTG GCT ATC ATT 2751
         A   A  A           T                                          T        A
     Q  R  R  T  R  S  E  S  T  V  E  S  F  F  A  R  G  A  C  V  A  I  I
2752 GAG GTG GAC AAT GAT GCA CCG ACA AAG CGC GCC AGC AGA TTG TTT TCG GTT TGG AAA ATA ACT TAC AAA 2820
                         A           A A                      A              C
     E  V  D  N  D  A  P  T  K  R  A  S  R  L  F  S  V  W  K  I  T  Y  K
2821 GAT ACT GTT CAA CTG AGA CGC AAA CTG GAA TTT TTC ACA TAT TCG AGA TTT GAC ATG GAG TTC ACT TTT 2889
        C                     A A                      A
     D  T  V  Q  L  R  R  K  L  E  F  F  T  Y  S  R  F  D  M  E  F  T  F
2890 GTG GTC ACC TCA AAC TAC ATT GAT GCA AAT AAC GGA CAT GCA TTG AAC CAA GTT TAT CAG ATA ATG TAT 2958
                         C    T                                     C           C
     V  V  T  S  N  Y  I  D  A  N  N  G  H  A  L  N  Q  V  Y  Q  I  M  Y
2959 ATA CCA CCC GGA GCA CCT ATC CCT GGT AAA TGG AAT GAC TAT ACG TGG CAG ACG TCC TCT AAC CCG TCG 3027
     T       A       A       A               C    T        T              A  A
     I  P  P  G  A  P  I  P  G  K  W  N  D  Y  T  W  Q  T  S  S  N  P  S
3028 GTG TTT TAC ACC TAT GGG GCG CCC CCA GCA AGA ATA TCA GTG CCC TAC GTG GGA ATT GCT AAT GCG TAT 3096
                         A                            T                       A
     V  F  Y  T  Y  G  A  P  P  A  R  I  S  V  P  Y  V  G  I  A  N  A  Y
3097 TCC CAC TTT TAT GAT GGG TTT GCA AAA GTA CCA CTA GCG GGT CAA GCC TCA ACT GAA GGC GAT TCG TTG 3165
                                                G        G  A                 T     A
     S  H  F  Y  D  G  F  A  K  V  P  L  A  G  Q  A  S  T  E  G  D  S  L
3166 TAC GGT GCT GCC TCA CTG AAT GAT TTT GGA TCA CTG GCT GTT CGC GTG GTA AAT GAT CAC AAC CCC ACG 3234
     T                                                   G A A  G                       A
     Y  G  A  A  S  L  N  D  F  G  S  L  A  V  R  V  V  N  D  H  N  P  T
3235 CGG CTC ACC TCC AAG ATC AGA GTG TAC ATG AAG CCA AAG CAT GTC AGA GTC TGG TGC CCA CGA CCT CCA 3303
     A                                                                           A       T
     R  L  T  S  K  I  R  V  Y  M  K  P  K  H  V  R  V  W  C  P  R  P  P
```

FIG. 27

```
2614 ACA GCC GTG GAG ACA GGG GCT ACC AAT CCG TTG GTG CCT TCG GAC ACC GTG CAA ACG CGC CAT GTC ATC 2682
       G   C           G   C  G  G       C C         G          C  G C C     C G           C
     T   A   V   E   T   G   A   T   N   P   L   V   P   S   D   T   V   Q   T   R   H   V   I
2683 CAG AGA CGA ACG CGA TCA GAG TCC ACG GTT GAG TCA TTC TTT GCA AGA GGG GCT TGC GTG GCT ATC ATT 2751
         C              G       C       G       C      G C C   C G       C G       T      C
     Q   R   R   T   R   S   E   S   T   V   E   S   F   F   A   R   G   A   C   V   A   I   I
2752 GAG GTG GAC AAT GAT GCA CCG ACA AAG CGC GCC AGC AGA TTG TTT TCG GTT TGG AAA ATA ACT TAC AAA 2820
             C       C   C  G      G           G TCG C                                     G
     E   V   D   N   D   A   P   T   K   R   A   S   R   L   F   S   V   W   K   I   T   Y   K
2821 GAT ACT GTT CAA CTG AGA CGC AAA CTG GAA TTT TTC ACA TAT TCG AGA TTT GAC ATG GAG TTC ACT TTT 2889
         G                C          C              G      C   C                          G C
     D   T   V   Q   L   R   R   K   L   E   F   F   T   Y   S   R   F   D   M   E   F   T   F
2890 GTG GTC ACC TCA AAC TAC ATT GAT GCA AAT AAC GGA CAT GCA TTG AAC CAA GTT TAT CAG ATA ATG TAT 2958
         C       G   G               C  C                   C G
     V   V   T   S   N   Y   I   D   A   N   N   G   H   A   L   N   Q   V   Y   Q   I   M   Y
2959 ATA CCA CCC GGA GCA CCT ATC CCT GGT AAA TGG AAT GAC TAT ACG TGG CAG ACG TCC TCT AAC CCG TCG 3027
             G   C   G   A            G                  C                    G   G
     I   P   P   G   A   P   I   P   G   K   W   N   D   Y   T   W   Q   T   S   S   N   P   S
3028 GTG TTT TAC ACC TAT GGG GCG CCC CCA GCA AGA ATA TCA GTG CCC TAC GTG GGA ATT GCT AAT GCG TAT 3096
             G   C   C      G       G   G C             G       G       C           C   G   C
     V   F   Y   T   Y   G   A   P   P   A   R   I   S   V   P   Y   V   G   I   A   N   A   Y
3097 TCC CAC TTT TAT GAT GGG TTT GCA AAA GTA CCA CTA GCG GGT CAA GCC TCA ACT GAA GGC GAT TCG TTG 3165
       G           C   C             C                 G   C                      G   G
     S   H   F   Y   D   G   F   A   K   V   P   L   A   G   Q   A   S   T   E   G   D   S   L
3166 TAC GGT GCT GCC TCA CTG AAT GAT TTT GGA TCA CTG GCT GTT CGC GTG GTA AAT GAT CAC AAC CCC ACG 3234
       C   G   G   G   C          G            G   C                  C                   C  G
     Y   G   A   A   S   L   N   D   F   G   S   L   A   V   R   V   V   N   D   H   N   P   T
3235 CGG CTC ACC TCC AAG ATC AGA GTG TAC ATG AAG CCA AAG CAT GTC AGA GTC TGG TGC CCA CGA CCT CCA 3303
         G   G             C C                       G             C    C C                G   T
     R   L   T   S   K   I   R   V   Y   M   K   P   K   H   V   R   V   W   C   P   R   P   P
```

FIG. 28

```
2614 ACA GCC GTG GAG ACA GGG GCT ACC AAT CCG TTG GTG CCT TCG GAC ACC GTG CAA ACG CGC CAT GTC ATC 2682
       G   C           G   C  G  G       C C   A   G       T       A               C   A   A
     T   A   V   E   T   G   A   T   N   P   L   V   P   S   D   T   V   Q   T   R   H   V   I
2683 CAG AGA CGA ACG CGA TCA GAG TCC ACG GTT GAG TCA TTC TTT GCA AGA GGG GCT TGC GTG GCT ATC ATT 2751
         C       T   T  AGC              G       C      G C C   C G       C G       T      C
     Q   R   R   T   R   S   E   S   T   V   E   S   F   F   A   R   G   A   C   V   A   I   I
2752 GAG GTG GAC AAT GAT GCA CCG ACA AAG CGC GCC AGC AGA TTG TTT TCG GTT TGG AAA ATA ACT TAC AAA 2820
             C   T   C   G      G           G TCG C   A              A               G   T
     E   V   D   N   D   A   P   T   K   R   A   S   R   L   F   S   V   W   K   I   T   Y   K
2821 GAT ACT GTT CAA CTG AGA CGC AAA CTG GAA TTT TTC ACA TAT TCG AGA TTT GAC ATG GAG TTC ACT TTT 2889
       G   A           A   C       T       C              T   G      C   C   T                T   G   C
     D   T   V   Q   L   R   R   K   L   E   F   F   T   Y   S   R   F   D   M   E   F   T   F
2890 GTG GTC ACC TCA AAC TAC ATT GAT GCA AAT AAC GGA CAT GCA TTG AAC CAA GTT TAT CAG ATA ATG TAT 2958
         C       T   C            G               C G     A                C G A           A
     V   V   T   S   N   Y   I   D   A   N   N   G   H   A   L   N   Q   V   Y   Q   I   M   Y
2959 ATA CCA CCC GGA GCA CCT ATC CCT GGT AAA TGG AAT GAC TAT ACG TGG CAG ACG TCC TCT AAC CCG TCG 3027
             G   C   G   G            G                C                      G   G
     I   P   P   G   A   P   I   P   G   K   W   N   D   Y   T   W   Q   T   S   S   N   P   S
3028 GTG TTT TAC ACC TAT GGG GCG CCC CCA GCA AGA ATA TCA GTG CCC TAC GTG GGA ATT GCT AAT GCG TAT 3096
       A       T   G   C   C       G   G C T           G   A   G           C       T   C   G   C
     V   F   Y   T   Y   G   A   P   P   A   R   I   S   V   P   Y   V   G   I   A   N   A   Y
3097 TCC CAC TTT TAT GAT GGG TTT GCA AAA GTA CCA CTA GCG GGT CAA GCC TCA ACT GAA GGC GAT TCG TTG 3165
       G           C   C             C                 G   C                      G   G       A
     S   H   F   Y   D   G   F   A   K   V   P   L   A   G   Q   A   S   T   E   G   D   S   L
3166 TAC GGT GCT GCC TCA CTG AAT GAT TTT GGA TCA CTG GCT GTT CGC GTG GTA AAT GAT CAC AAC CCC ACG 3234
       C   G   G   G   T   C          G            G   C   A                C       T       G
     Y   G   A   A   S   L   N   D   F   G   S   L   A   V   R   V   V   N   D   H   N   P   T
3235 CGG CTC ACC TCC AAG ATC AGA GTG TAC ATG AAG CCA AAG CAT GTC AGA GTC TGG TGC CCA CGA CCT CCA 3303
       T   G   G       ACC   A   T                G             C   ACC   A               G       T
     R   L   T   S   K   I   R   V   Y   M   K   P   K   H   V   R   V   W   C   P   R   P   P
```

FIG. 29

```
2614 ACA GCC GTG GAG ACA GGG GCT ACC AAT CCG TTG GTG CCT TCG GAC ACC GTG CAA ACG CGC CAT GTC ATC 2682
      G   C       G   T   G G           C T   C   G           G   C       G       A
      T   A   V   E   T   G   A   T   N   P   L   V   P   S   D   T   V   Q   T   R   H   V   I
2683 CAG AGA CGA ACG CGA TCA GAG TCC ACG GTT GAG TCA TTC TTT GCA AGA GGG GCT TGC GTG GCT ATC ATT 2751
      C   G   G       G G       G       C       G               GCG T       C   G   A   A
      Q   R   R   T   R   S   E   S   T   V   E   S   F   F   A   R   G   A   C   V   A   I   I
2752 GAG GTG GAC AAT GAT GCA CCG ACA AAG CGC GCC AGC AGA TTG TTT TCG GTT TGG AAA ATA ACT TAC AAA 2820
                          G   A   G   G TCG C G C T       C                       G
      E   V   D   N   D   A   P   T   K   R   A   S   R   L   F   S   V   W   K   I   T   Y   K
2821 GAT ACT GTT CAA CTG AGA CGC AAA CTG GAA TTT TTC ACA TAT TCG AGA TTT GAC ATG GAG TTC ACT TTT 2889
              G   C       TCG G       T               G       C G                       G
      D   T   V   Q   L   R   R   K   L   E   F   F   T   Y   S   R   F   D   M   E   F   T   F
2890 GTG GTC ACC TCA AAC TAC ATT GAT GCA AAT AAC GGA CAT GCA TTG AAC CAA GTT TAT CAG ATA ATG TAT 2958
      C   G G           A       G       T   GCT           C
      V   V   T   S   N   Y   I   D   A   N   N   G   H   A   L   N   Q   V   Y   Q   I   M   Y
2959 ATA CCA CCC GGA GCA CCT ATC CCT GGT AAA TGG AAT GAC TAT ACG TGG CAG ACG TCC TCT AAC CCG TCG 3027
              G   T   G G   A   G                                   G   G
      I   P   P   G   A   P   I   P   G   K   W   N   D   Y   T   W   Q   T   S   S   N   P   S
3028 GTG TTT TAC ACC TAT GGG GCG CCC CCA GCA AGA ATA TCA GTG CCC TAC GTG GGA ATT GCT AAT GCG TAT 3096
      C           G       T       G   G   GCG C   G   C   G       C   T   C   G
      V   F   Y   T   Y   G   A   P   P   A   R   I   S   V   P   Y   V   G   I   A   N   A   Y
3097 TCC CAC TTT TAT GAT GGG TTT GCA AAA GTA CCA CTA GCG GGT CAA GCC TCA ACT GAA GGC GAT TCG TTG 3165
      G   T           T       G           C   G   T           G G G       T           C T
      S   H   F   Y   D   G   F   A   K   V   P   L   A   G   Q   A   S   T   E   G   D   S   L
3166 TAC GGT GCT GCC TCA CTG AAT GAT TTT GGA TCA CTG GCT GTT CGC GTG GTA AAT GAT CAC AAC CCC ACG 3234
          G   G   T               T   G   T   G   C   G   C           T               G
      Y   G   A   A   S   L   N   D   F   G   S   L   A   V   R   V   V   N   D   H   N   P   T
3235 CGG CTC ACC TCC AAG ATC AGA GTG TAC ATG AAG CCA AAG CAT GTC AGA GTC TGG TGC CCA CGA CCT CCA 3303
      T       G   A   ACG C                       G   A       C G               G   G       T
      R   L   T   S   K   I   R   V   Y   M   K   P   K   H   V   R   V   W   C   P   R   P   P
```

FIG. 30

```
2614 ACA GCC GTG GAG ACA GGG GCT ACC AAT CCG TTG GTG CCT TCG GAC ACC GTG CAA ACG CGC CAT GTC ATC 2682
      G   A               C           C   A               A       G   A       T   C
      T   A   V   E   T   G   A   T   N   P   L   V   P   S   D   T   V   Q   T   R   H   V   I
2683 CAG AGA CGA ACG CGA TCA GAG TCC ACG GTT GAG TCA TTC TTT GCA AGA GGG GCT TGC GTG GCT ATC ATT 2751
      A   G       G   G       T           T       C               A       T       C T
      Q   R   R   T   R   S   E   S   T   V   E   S   F   F   A   R   G   A   C   V   A   I   I
2752 GAG GTG GAC AAT GAT GCA CCG ACA AAG CGC GCC AGC AGA TTG TTT TCG GTT TGG AAA ATA ACT TAC AAA 2820
      A   T           T   A           T           T           A   C           G
      E   V   D   N   D   A   P   T   K   R   A   S   R   L   F   S   V   W   K   I   T   Y   K
2821 GAT ACT GTT CAA CTG AGA CGC AAA CTG GAA TTT TTC ACA TAT TCG AGA TTT GAC ATG GAG TTC ACT TTT 2889
      C   C       G   C       T   G T       G C T           A G                       C
      D   T   V   Q   L   R   R   K   L   E   F   F   T   Y   S   R   F   D   M   E   F   T   F
2890 GTG GTC ACC TCA AAC TAC ATT GAT GCA AAT AAC GGA CAT GCA TTG AAC CAA GTT TAT CAG ATA ATG TAT 2958
              I   A   C   T   I               C   T G C   A T           C                   C
      V   V   T   S   N   Y   I   D   A   N   N   G   H   A   L   N   Q   V   Y   Q   I   M   Y
2959 ATA CCA CCC GGA GCA CCT ATC CCT GGT AAA TGG AAT GAC TAT ACG TGG CAG ACG TCC TCT AAC CCG TCG 3027
      T       G           G           C   G       T   C   A                   A           A   A
      I   P   P   G   A   P   I   P   G   K   W   N   D   Y   T   W   Q   T   S   S   N   P   S
3028 GTG TTT TAC ACC TAT GGG GCG CCC CCA GCA AGA ATA TCA GTG CCC TAC GTG GGA ATT GCT AAT GCG TAT 3096
              T   C           A   T       T                                       C       C   A
      V   F   Y   T   Y   G   A   P   P   A   R   I   S   V   P   Y   V   G   I   A   N   A   Y
3097 TCC CAC TTT TAT GAT GGG TTT GCA AAA GTA CCA CTA GCG GGT CAA GCC TCA ACT GAA GGC GAT TCG TTG 3165
      T   T           C                           A   C               A   G   T           C
      S   H   F   Y   D   G   F   A   K   V   P   L   A   G   Q   A   S   T   E   G   D   S   L
3166 TAC GGT GCT GCC TCA CTG AAT GAT TTT GGA TCA CTG GCT GTT CGC GTG GTA AAT GAT CAC AAC CCC ACG 3234
      T   A   G   T   T               C   C                   A           G       C               T
      Y   G   A   A   S   L   N   D   F   G   S   L   A   V   R   V   V   N   D   H   N   P   T
3235 CGG CTC ACC TCC AAG ATC AGA GTG TAC ATG AAG CCA AAG CAT GTC AGA GTC TGG TGC CCA CGA CCT CCA 3303
      T       A   A                           A                   C                   G           T   G       C T
      R   L   T   S   K   I   R   V   Y   M   K   P   K   H   V   R   V   W   C   P   R   P   P
```

MODULATION OF REPLICATIVE FITNESS BY DEOPTIMIZATION OF SYNONYMOUS CODONS

CROSS REFERENCE TO RELATED APPLICATIONS

This is a divisional of co-pending U.S. application Ser. No. 15/994,074, filed May 31, 2018, which is a divisional of U.S. application Ser. No. 15/684,355, filed Aug. 23, 2017, now abandoned, which is a divisional of U.S. application Ser. No. 14/464,619, filed Aug. 20, 2014, now abandoned, which is a divisional of U.S. application Ser. No. 11/576,941, filed Nov. 19, 2007, now U.S. Pat. No. 8,846,051, issued Sep. 30, 2014, which is the U.S. National Stage of International Application No. PCT/US2005/036241, filed Oct. 7, 2005, which was published in English under PCT Article 21(2), which in turn claims benefit of U.S. Provisional Application No. 60/617,545 filed Oct. 8, 2004. Each application is incorporated by reference in its entirety.

ACKNOWLEDGMENT OF GOVERNMENT SUPPORT

This invention was made by the National Center for Infectious Diseases, Centers for Disease Control and Prevention, an agency of the United States Government. Therefore, the U.S. Government has certain rights in this invention.

FIELD

This disclosure relates to methods of reducing the replicative fitness of a pathogen by deoptimizing codons. Pathogens with deoptimized codons can be used to increase the phenotypic stability of attenuated vaccines.

BACKGROUND

Infections by intracellular pathogens such as viruses, bacteria and parasites, are cleared in most cases after activation of specific T cellular immune responses that recognize foreign antigens and eliminate infected cells. Vaccines against those infectious organisms have been traditionally developed by administration of whole live attenuated or inactivated microorganisms. Although research has been performed using subunit vaccines, the levels of cellular immunity induced are usually low and not capable of eliciting complete protection against diseases caused by intracellular microbes.

One problem encountered when using live attenuated vaccines is the development of adverse events in some patients. Typical reactions associated with live viral and bacterial vaccines, such as measles, mumps, rubella (MMR) and varicella vaccines, often resemble attenuated forms of the disease against which the vaccine is directed. However, more severe adverse affects have been reported. For example, there is an association between the Urabe strain of mumps vaccine and viral meningitis (Dubey and Banerjee, *Indian J. Pediatr.* 70:579-84, 2003). In addition, vaccine associated thrombocytopenia has been reported. Although epidemiological studies do not support a causative link between MMR and autism (Chen et al., *Psychol. Med.* 34:543-53, 2004), the fear remains and likely contributes to poor vaccine acceptance in some regions and sections of society.

In addition, documented safety concerns with vaccines demonstrate the harm that vaccines can cause. For example, the currently available attenuated Sabin oral polio vaccine (OPV) strains are genetically unstable, principally because only 2-5 base substitutions confer the attenuated phenotype (Ren et al. *J. Virol.* 65:1377-82, 1991). This instability is the underlying cause of vaccine-associated paralytic poliomyelitis in immunologically normal (Strebel et al., *Clin. Infect. Dis.* 14:568-79, 1992) and in people with B-cell immunodeficiencies (Kew et al., *J. Clin. Microbiol.* 36:2893-9; Khetsuriani et al., *J. Infect. Dis* 188:1845-52, 2003; Yang et al., J. Virol. 79:12623-34), and of outbreaks associated with circulating vaccine-derived polioviruses (Kew et al., *Science* 296: 356-9, 2002; Yang et al., *J. Virol.* 77:8366-77, 2003; Rousset et al., *Emerg. Inf. Dis.* 9:885-7, 2003; Kew et al., *Bull. WHO* 82:16-23, 2004; Shimizu et al., *J. Virol.* 78:13512-21, 2004; Kew et al., *Ann. Rev. Microbiol.* 59:587-635, 2005). In addition, the CDC recommended suspending use of the rhesus-human rotavirus reassortant-tetravalent vaccine (RRV-TV) due to cases of intussusception (a bowel obstruction in which one segment of bowel becomes enfolded within another segment) among infants who received the vaccine (*MMWR Morb Mortal Wkly Rep.* 53:786-9, 2004).

Although the primary mode of protective immunity induced by OPV is the production of neutralizing antibody by B-cells, OPV stimulates an immune response similar to that of a natural infection. Immunity against paralytic disease is further enhanced by the production of antibodies in the gastrointestinal tract that limit poliovirus replication, and, thus, person-to-person transmission. The stimulation of intestinal immunity, along with ease of administration, has made OPV the vaccine of choice for global polio eradication (Aylward and Cochi, *Bull. WHO* 82:40-6, 2004). Therefore, there is a need to identify methods of making an attenuated vaccine that reduces the safety concerns with currently available live attenuated vaccines while retaining the advantages of attenuated vaccines.

SUMMARY

The inventors have determined that replacement of one or more natural (or native) codons in a pathogen with synonymous unpreferred codons can decrease the replicative fitness of the pathogen, thereby attenuating the pathogen. The unpreferred synonymous codon(s) encode the same amino acid as the native codon(s), but have nonetheless been found to reduce a pathogen's replicative fitness. The introduction of deoptimized codons into a pathogen can limit the ability of the pathogen to mutate or to use recombination to become virulent. The disclosed compositions and methods can be used in attenuated vaccines having well-defined levels of replicative fitness and enhanced genetic stabilities.

Methods of reducing a pathogen's replicative fitness are disclosed. In some examples, the method includes deoptimizing at least one codon in a coding sequence of the pathogen, thereby generating a deoptimized coding sequence. Such deoptimization reduces replicative fitness of the pathogen. In some examples, more than one coding sequence of the pathogen is deoptimized, such as at least one, at least two, or at least 5 coding sequences, such as deoptimizing 1, 2, 3, 4, 5, 6, 7, 8, 9 or 10 coding sequences of the pathogen.

More than one codon in the one or more coding sequences can be deoptimized, such as at least 15 codons, at least 20 codons, at least 30 codons, at least 40 codons, at least 50 codons, at least 60 codons, at least 70 codons, at least 100 codons, at least 200 codons, at least 500 codons, or even at least 1000 codons, in each coding sequence. In some examples, at least 20% of the coding sequence of each desired gene is deoptimized, such as at least 30%, at least 40%, at least 50%, at least 60%, at least 70%, at least 80%, at least 90%, at least 95%, or even at least 97% deoptimized.

In particular examples, deoptimizing the codon composition alters the G+C content of a coding sequence, such as increases or decreases the G+C content by at least 10%, for example increases the G+C content of a coding sequence by at least 10%, such as at least 20%, at least 30%, at least 40%, at least 50%, at least 60%, at least 70%, at least 80%, or even by at least 90%, or decreases the G+C content of a coding sequence by at least 10%, such as at least 20%, at least 30%, at least 40%, at least 50%, at least 60%, at least 70%, at least 80%, or even by at least 90%. However, the G+C content can be altered in combination with deoptimizing one or more codons in a pathogen sequence. For example, some of the nucleotide substitutions can be made to deoptimize codons (which may or may not alter the G+C content of the sequence), and other nucleotide substitutions can be made to alter the G+C content of the sequence (which may or may result in a deoptimized codon). Altering the G+C content of the sequence may also result in a deoptimized codon, but is not required in all instances.

For example, if the pathogen is a rubella virus, whose RNA genome has a high G+C content and consequently has a high rate of usage of rare codons rich in G+C. Therefore, deoptimization of rubella virus can be achieved by decreasing the G+C content of one or more coding sequences, for example decreasing the G+C content by at least 10%, such as at least 20%, or even by at least 50%. In another example, the pathogen is a poliovirus, and deoptimization can be achieved by increasing the G+C content of one or more coding sequences, for example increasing the G+C content by at least 10%, such as at least 20%, or even by at least 50%.

In some examples, deoptimizing the codon composition alters the frequency of CG dinucleotides, TA dinucleotides, or both, in a coding sequence, such as increases or decreases the frequency of CG or TA dinucleotides by at least 10%, for example increases in the number of CG or TA dinucleotides in a coding sequence by at least 10%, such as at least 20%, at least 30%, at least 40%, at least 50%, at least 60%, at least 100%, at least 200%, or even by at least 300%, or decreases in the number of CG or TA dinucleotides in a coding sequence by at least 10%, such as at least 20%, at least 30%, at least 40%, at least 50%, at least 60%, at least 70%, at least 80%, or even by at least 90%. However, the number of CG or TA dinucleotides can be altered in combination with deoptimizing one or more codons in a pathogen sequence. For example, some of the nucleotide substitutions can be made to deoptimize codons (which may or may not alter the number of CG or TA dinucleotides in the sequence), and other nucleotide substitutions can be made to alter the number of CG or TA dinucleotides in the coding sequence (which may or may result in a deoptimized codon). Altering the number of CG or TA dinucleotides in the sequence may also result in a deoptimized codon, but is not required in all instances.

For example, if the pathogen is a poliovirus or eukaryotic virus, deoptimization can be achieved by increasing the number of CG or TA dinucleotides in one or more coding sequences, for example increasing the number of CG or TA dinucleotides by at least 10%, such as at least 30%, or even by at least 300%. In another example, the pathogen is a bacterium, and deoptimization can be achieved by decreasing the number of CG or TA dinucleotides in one or more coding sequences, for example decreasing the number of CG or TA dinucleotides by at least 10%, such as at least 30%, or even by at least 50%.

In particular examples, methods of reducing the replicative fitness of a pathogen include analysis of a codon usage table for the pathogen to identify amino acids that are encoded by at least 2 different codons, (such as 2 different codons, 3 different codons, 4 different codons, or 6 different codons), and choosing the codon used least frequently (lowest codon usage frequency) of the different codons in the pathogen. The one or more low-frequency codons chosen are used to replace the appropriate one or more codons in the native sequence, for example using molecular biology methods, thereby generating a deoptimized sequence that reduces the replicative fitness of the pathogen. For example, if the pathogen uses the CCU, CCC, CCA and CCG codons to encode for Pro at 12, 19, 21 and 9% frequency respectively, the CCG codon can be used to replace at least one CCU, CCC, or CCA codon in the native pathogen sequence, thereby generating a deoptimized sequence. In this example, the use of the CCG codon may also increase the number of CG dinucleotides in the sequence, and may also increase the G+C content of the sequence. In examples where the amino acid is encoded by only two different codons, one of the two codons can be selected and used in the deoptimized sequence if the codon usage is highly biased, such as a difference of at least 10%, at least 20%, or at least 30%. For example, if the pathogen uses the codons CAA and CAG to encode for Gln at 60% and 40% frequency respectively, the CAG codon is used to replace at least one CAA codon in the native sequence, thereby generating a deoptimized sequence. In this example, the use of the CAG codon may also increase the G+C content of the sequence.

In some examples, when choosing a low frequency codon, the codon chosen based on its ability to alter the G+C content of the deoptimized sequence or alter the frequency of CG or TA dinucleotides. For example, if the pathogen uses the CCU, CCC, CCA and CCG codons to encode for Pro at 9, 19, 21 and 12% frequency respectively, the CCG codon can be used to replace at least one CCU, CCC, or CCA codon in the native pathogen sequence, if the presence of increased G+C content or increased numbers of CG dinucleotides is desired in the deoptimized sequence. Even though CCG is not the most infrequently used codon, the use of this codon will increase the number of CG dinucleotides in the sequence and may increase the G+C content of the deoptimized sequence. In contrast, if the presence of decreased G+C content or decreased numbers of CG dinucleotides is desired in the deoptimized sequence, the CCU codon could be used to replace at least one CCG, CCC, or CCA codon in the native pathogen sequence.

In some examples, there may be two or more codons used at low frequencies that are similar in value, such as codon usages that are within 0.01-2% of each other (for example within 0.1-2%, 0.5-2% or 1-2% of each other). In this case, one can opt to not choose the codon with the lowest codon usage frequency. In some examples, the codon chosen is one that will alter the G+C content of the deoptimized sequence, such as increase or decrease the G+C content of the sequence. In other examples, the codon chosen is one that increases or decreases the frequency of a specific dinucleotide pair (such as a CG or TA dinucleotide pair) found at low frequencies in that genome (such as no more than 4%, for example no more than 3%). Such dinucleotide pairs can fall across codon boundaries, or be contained within the codon.

The codon usage table used can include codon usage data from the complete genome of the pathogen (or 2 or more genomes, for example from different strains of the pathogen), codon usage data from one or more genes (such as 1 gene, at least 2 genes, at least 3 genes, at least 5 genes, or even at least 10 genes), for example one or more genes involved in the antigenicity of the pathogen.

Specific non-limiting examples of deoptimized coding sequences for several pathogens are disclosed herein. In some examples, a deoptimized coding sequence includes a nucleic acid sequence having at least 90% sequence identity, such as at least 95% sequence identity, to any of SEQ ID NOS: 5, 8, 11, 14, 18, 21, 24, 27, 30, 33, 36, 39, 42, 45, 48, 51, 54, 55, 56, 57, 58, 67, 68, or 69. Sequences that hybridize to any of SEQ ID NOS: 5, 8, 11, 14, 18, 21, 24, 27, 30, 33, 36, 39, 42, 45, 48, 51, 54, 55, 56, 57, 58, 67, 68, or 69, for example under stringent conditions, are also disclosed. In some examples, a deoptimized coding sequence includes a nucleic acid sequence shown in any of SEQ ID NOS: 5, 8, 11, 14, 18, 21, 24, 27, 30, 33, 36, 39, 42, 45, 48, 51, 54, 55, 56, 57, 58, 67, 68, or 69.

In particular examples, more than one coding sequence in the pathogen is deoptimized, such as at least 2 coding sequences, such as at least 3, at least 4, at least 5, at least 6, at least 7, at least 8, at least 9, or even at least 10 coding sequences. Any coding sequence can be deoptimized. In one example, one of the deoptimized coding sequences encodes for a housekeeping gene. Particular examples of coding sequences that can be deoptimized in a pathogen, include, but are not limited to, sequences that encode a viral capsid, a viral spike glycoprotein (for example the gH and gE surface glycoproteins of varicella-zoster virus); glycoprotein B, glycoprotein D, glycoprotein H, and glycoprotein N of human cytomegalovirus; glycoprotein D, tegument protein host shut-off factor, ribonucleotide reductase large subunit of human herpes simplex viruses; the fusion (F) protein and glycoprotein (G) of respiratory syncytial virus; the hemagglutinin (HA) and neuraminidase (NA) glycoproteins of influenza virus; the env protein of human immunodeficiency virus type 1 (HIV-1), ArgS and TufA gene products of *Escherichia coli*, or combinations thereof.

The replicative fitness of the pathogen can be reduced by any amount sufficient to attenuate the pathogen. In some examples, the replicative fitness of the deoptimized pathogen is reduced by at least 20%, such as at least 30%, at least 40%, at least 48%, at least 50%, at least 75%, at least 80%, at least 90%, at least 95%, or even at least 97%, as compared to replicative fitness of a pathogen (of the same species and strain) having a coding sequence with an optimized codon composition.

Any pathogen can be attenuated using the disclosed methods. Particular examples include, but are not limited to, viruses (such as positive-strand RNA viruses, negative-strand RNA viruses, DNA viruses, and retroviruses), bacteria, fungi, and protozoa.

In one specific example, the pathogen is a poliovirus. For example, when the natural codons of the Sabin type 2 (Sabin 2) OPV strain (Sabin and Boulger. *J. Biol. Stand.* 1:115-8; 1973; Toyoda et al., *J. Mol. Biol.* 174:561-85, 1984) were replaced with synonymous unpreferred codons in sequences encoding capsid proteins, virus plaque size and yield in cell culture decreased in proportion to the number of unpreferred codons incorporated into the capsid sequences. The altered codon composition was largely conserved during 25 serial passages in HeLa cells. Fitness for replication in HeLa cells of both the unmodified Sabin 2 and modified constructs increased with higher passage; however, the relative fitness of the modified constructs remained lower than that of the unmodified construct.

Attenuated pathogens produced by the methods disclosed herein are also provided. In one example, immunogenic compositions include an attenuated pathogen produced by the disclosed methods. Such immunogenic compositions can include other agents, such as an adjuvant, a pharmaceutically acceptable carrier, or combinations thereof.

Methods are disclosed for eliciting an immune response against a pathogen in a subject, using the disclosed attenuated pathogens. In one example, the method includes administering an immunologically effective amount of the disclosed attenuated pathogens to a subject, thereby eliciting an immune response in the subject. In particular examples, the disclosed attenuated pathogens are present in an immunogenic composition which is administered to a subject. Subjects include human and veterinary subjects, such as cats, dogs, cattle, sheep, pigs and horses.

The foregoing and other features and advantages of the disclosure will become more apparent from the following detailed description of a several embodiments.

BRIEF DESCRIPTION OF THE FIGURES

FIGS. 1B-1D is a sequence showing original S2R9 Sabin 2 triplets (ABCD, SEQ ID NO: 3) above the codon-replacement residues; the deduced amino acids for both constructs are indicated below the triplets (SEQ ID NO: 4). The fully replaced sequence (abcd, SEQ ID NO: 5) is referred to S2R23.

FIG. 3A is a graph showing mean plaque area in HeLa cells versus the number of nucleotide substitutions in the capsid region. The coefficient of determination ($R^2$) for the regression line was 0.88.

FIG. 3B is a graph showing virus yields (12-hour postinfection) of a single-step growth curve versus the number of nucleotide substitutions in the capsid region. The coefficient of determination ($R^2$) for the regression line was 0.94.

FIG. 3C is a digital image showing plaque phenotypes at 35° C. in HeLa cells.

FIGS. 5A and 5B are digital images showing production of intracellular Poliovirus-specific proteins produced by ABCD, ABCd, and abcd viruses in vivo and in vitro. (A) Lysates of infected HeLa cells labeled with [$^{35}$S]methionine at 4 to 7 hours postinfection. (B) In vitro translation products from rabbit reticulocyte lysates programmed with 250 ng of RNA transcripts from cDNAs ABCD, ABCd, and abcd. Noncapsid proteins were identified by their electrophoretic mobilities and band intensities; capsid proteins were identified by their comigration with proteins from purified virions.

FIGS. 5C and 5D are digital images showing production of intracellular MEF Poliovirus-specific proteins produced by ABC, ABc, and abc viruses in vivo and in vitro. (A) Lysates of infected HeLa cells labeled with [$^{35}$S]methionine at 4 to 7 hours postinfection. (B) In vitro translation products from rabbit reticulocyte lysates programmed with 250 ng of RNA transcripts from cDNAs ABC, ABc, and abc. Noncapsid proteins were identified by their electrophoretic mobilities and band intensities; capsid proteins were identified by their comigration with proteins from purified virions.

FIG. 8A is a graph showing mean plaque areas of evolving viruses using a plaque assay of HeLa cells after 60 hours incubation at 35° C.

FIG. 8B is a graph showing virus titers determined by plaque assay of HeLa cells at 35° C. on every fifth passage.

FIG. 8C is a digital image showing plaque phenotypes at 35° C. in HeLa cells (35° C., 60 hours).

FIGS. 9A-E show an original MEF1 capsid sequence (SEQ ID NO: 6; GenBank Accession No. AY082677) above the codon-replacement residues for an MEF1 de-optimized capsid sequence (SEQ ID NO: 8) (only replaced nucleotides are indicated); the deduced amino acids for both the constructs are indicated below the triplets (SEQ ID NO: 7).

FIGS. 10A-10B show an original FMDV capsid sequence (SEQ ID NO: 9; GenBank Accession No. AJ539141) above the codon-replacement residues for an FMDV de-optimized capsid sequence (SEQ ID NO: 11) (only replaced nucleotides are indicated; the deduced amino acids are indicated below the triplets (SEQ ID NO: 10).

FIGS. 11A-11C show an original SARS spike glycoprotein sequence (SEQ ID NO: 12; GenBank Accession No. AY278741) above the codon-replacement residues for a de-optimized SARS spike glycoprotein sequence (SEQ ID NO: 14) (only replaced nucleotides are indicated); the deduced amino acids are indicated below the triplets (SEQ ID NO: 13).

FIGS. 12A-12G shows an original rubella sequence (SEQ ID NO: 15; GenBank Accession No. L78917) above the codon-replacement residues for a de-optimized rubella sequence (SEQ ID NO: 18) (only replaced nucleotides are indicated); the deduced amino acids are indicated below the triplets (SEQ ID NOS: 16 and 17).

FIGS. 13A-B show an original VZV gH sequence (GenBank Accession No. AB097932, SEQ ID NO: 19) above the codon-replacement residues for a de-optimized VZV gH sequence (SEQ ID NO: 21) (only replaced nucleotides are indicated); the deduced amino acids are indicated below the triplets (SEQ ID NO: 20).

FIGS. 14A-B show an original VZV gE sequence (GenBank Accession No. AB097933, SEQ ID NO: 22) above the codon-replacement residues for a de-optimized VZV gE sequence (SEQ ID NO: 24) (only replaced nucleotides are indicated); the deduced amino acids are indicated below the triplets (SEQ ID NO: 23).

Figure 15A:
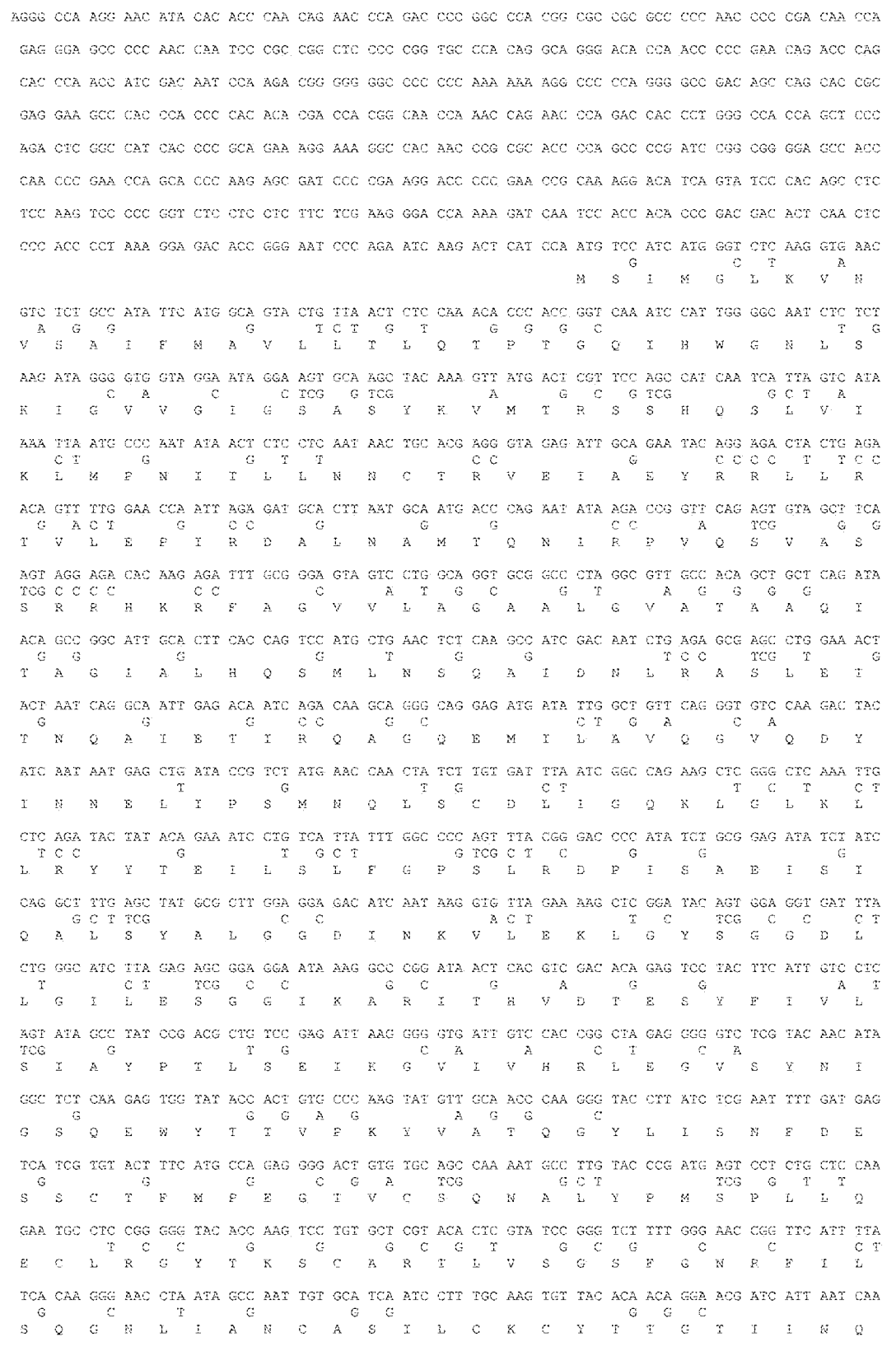

FIGS. 15A-B show an original measles F sequence (SEQ ID NO: 25; GenBank Accession No. AF266287) above the codon-replacement residues for a de-optimized measles F sequence (SEQ ID NO: 27) (only replaced nucleotides are indicated); the deduced amino acids are indicated below the triplets (SEQ ID NO: 26).

FIGS. 16A-B show an original measles hemagglutinin (H) sequence (SEQ ID NO: 28; GenBank Accession No. AF266287) above the codon-replacement residues for a de-optimized measles H sequence (SEQ ID NO: 30) (only replaced nucleotides are indicated); the deduced amino acids are indicated below the triplets (SEQ ID NO: 29).

FIGS. 17A-B show an original RSV F sequence (SEQ ID NO: 31; GenBank Accession No. U63644) above the codon-replacement residues for a de-optimized RSV F sequence (SEQ ID NO: 33) (only replaced nucleotides are indicated); the deduced amino acids are indicated below the triplets (SEQ ID NO: 32).

FIG. 18 shows an original RSV G sequence (SEQ ID NO: 34; GenBank Accession No. U63644) above the codon-replacement residues for a de-optimized RSV G sequence (SEQ ID NO: 36) (only replaced nucleotides are indicated); the deduced amino acids are indicated below the triplets (SEQ ID NO: 35).

FIG. 19 shows an original influenza HA sequence (SEQ ID NO: 37) above the codon-replacement residues for a de-optimized influenza HA sequence (SEQ ID NO: 39) (only replaced nucleotides are indicated); the deduced amino acids are indicated below the triplets (SEQ ID NO: 38).

FIG. 20 shows an original influenza NA sequence (SEQ ID NO: 40) above the codon-replacement residues for a de-optimized influenza NA sequence (SEQ ID NO: 42) (only replaced nucleotides are indicated); the deduced amino acids are indicated below the triplets (SEQ ID NO: 41).

FIGS. 21A-21B show an original HIV-1 env sequence (SEQ ID NO: 43; GenBank Accession No. AF110967) above the codon-replacement residues for a de-optimized HIV-1 env sequence (SEQ ID NO: 45) (only replaced nucleotides are indicated); the deduced amino acids are indicated below the triplets (SEQ ID NO: 44).

FIGS. 22A-22B show an original *E. coli* ArgS sequence (SEQ ID NO: 46; GenBank Accession No. U0096) above the codon-replacement residues for a de-optimized *E. coli* ArgS sequence (SEQ ID NO: 48) (only replaced nucleotides are indicated); the deduced amino acids are indicated below the triplets (SEQ ID NO: 47).

FIG. 23 shows an original *E. coli* TufA sequence (SEQ ID NO: 49; GenBank Accession No. J01690) above the codon-replacement residues for a de-optimized *E. coli* TufA sequence (SEQ ID NO: 51) (only replaced nucleotides are indicated); the deduced amino acids are indicated below the triplets (SEQ ID NO: 50).

FIGS. 24A-24M show exemplary codon usage tables for various pathogens.

FIG. 25 shows a Sabin 2 virus cassette d (VP1 region) sequence that has been altered by reducing the number of CG dinucleotides. The original sequence (nucleotides 1975-2664 of SEQ ID NO: 3) is shown above the codon-replacement residues for an altered Sabin 2 cassette d (VP1 region) sequence (SEQ ID NO: 65) (only replaced nucleotides are indicated); the deduced amino acids are indicated below the triplets (amino acids 623-852 of SEQ ID NO: 4).

FIG. 26 shows a Sabin 2 virus cassette d (VP1 region) sequence that has been altered by decreasing the number of CG and TA dinucleotides. The original sequence (nucleotides 1975-2664 of SEQ ID NO: 3) is shown above the codon-replacement residues for an altered Sabin 2 cassette d (VP1 region) sequence (SEQ ID NO: 66) (only replaced nucleotides are indicated); the deduced amino acids are indicated below the triplets (amino acids 623-852 of SEQ ID NO: 4).

FIG. 27 shows a Sabin 2 virus cassette d (VP1 region) sequence that has been altered by increasing the number of CG dinucleotides. The original sequence (nucleotides 1975-2664 of SEQ ID NO: 3) is shown above the codon-replacement residues for a de-optimized Sabin 2 cassette d (VP1 region) sequence (SEQ ID NO: 67) (only replaced nucleotides are indicated); the deduced amino acids are indicated below the triplets (amino acids 623-852 of SEQ ID NO: 4). Original CG dinucleotides retained after codon changes are underlined.

FIG. 28 shows a Sabin 2 virus cassette d (VP1 region) sequence that has been altered by increasing the number of CG and TA dinucleotides. The original sequence (nucleotides 1975-2664 of SEQ ID NO: 3) is shown above the codon-replacement residues for a de-optimized Sabin 2 cassette d (VP1 region) sequence (SEQ ID NO: 68) (only replaced nucleotides are indicated); the deduced amino acids are indicated below the triplets (amino acids 623-852 of SEQ ID NO: 4). Original CG, TA dinucleotides retained after codon changes are underlined.

FIG. 29 shows a Sabin 2 virus cassette d (VP1 region) sequence having maximum codon deoptimization. The original sequence (nucleotides 1975-2664 of SEQ ID NO: 3) is shown above the codon-replacement residues for the de-optimized Sabin 2 cassette d (VP1 region) sequence (SEQ ID NO: 69) (only replaced nucleotides are indicated); the deduced amino acids are indicated below the triplets (amino acids 623-852 of SEQ ID NO: 4). Original CG dinucleotides retained after codon changes are underlined.

FIG. 30 shows a Sabin 2 virus cassette d (VP1 region) sequence that has MEF1 codons for Sabin 2 amino acids. The original sequence (nucleotides 1975-2664 of SEQ ID NO: 3) is shown above the codon-replacement residues; the deduced amino acids are indicated below the triplets (amino acids 623-852 of SEQ ID NO: 4). The altered Sabin 2 cassette d (VP1 region) sequence (SEQ ID NO: 70) is shown below the original sequence (only replaced nucleotides are indicated). The amino acids that differ between Sabin 2 and MEF-1 are underlined.

SEQUENCE LISTING

Figure 1A:
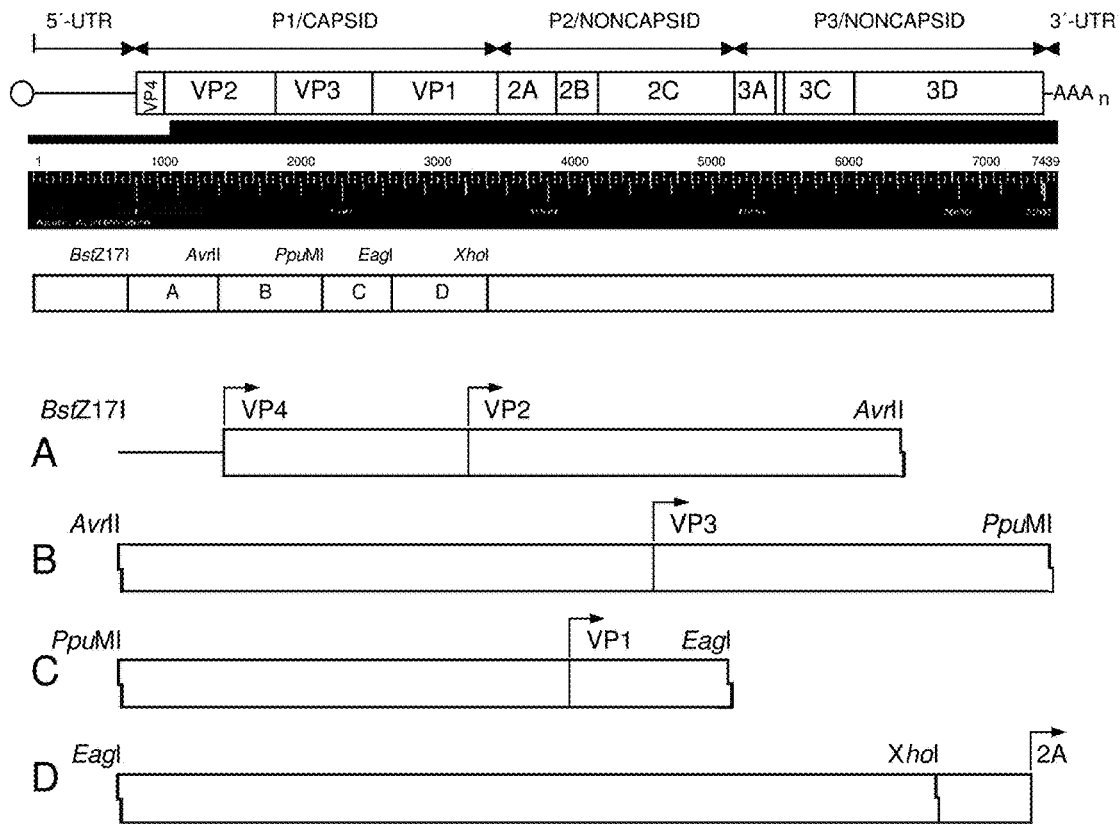
FIG. 1A is a schematic drawing showing the locations of the codon replacement cassettes A-D in the infectious Sabin 2 (S2R9) cDNA clone. The restriction sites used for construction of the codon replacement constructs are indicated at the appropriate positions, in the context of the mature viral proteins.

The nucleic acid and amino acid sequences listed in the accompanying sequence listing are shown using standard letter abbreviations for nucleotide bases, and three-letter code for amino acids. Only one strand of each nucleic acid sequence is shown, but the complementary strand is understood as included by any reference to the displayed strand. The Sequence Listing is submitted as an ASCII text file in the form of the file named Sequence_Listing.txt, which was created on Dec. 30, 2021, and is 1,108,235 bytes, which is incorporated by reference herein.

SEQ ID NO: 1 is a primer sequence used to reverse transcribe poliovirus cDNA.

SEQ ID NO: 2 is a primer sequence used to long PCR amplify poliovirus cDNA.

SEQ ID NO: 3 is a capsid nucleic acid coding sequence of Sabin 2 (construct S2R9) poliovirus.

SEQ ID NO: 4 is a protein sequence encoded by SEQ ID NO: 3.

SEQ ID NO: 5 is a Sabin 2 codon-deoptimized nucleic acid sequence.

SEQ ID NO: 6 is a capsid nucleic acid coding sequence of MEF1 poliovirus.

SEQ ID NO: 7 is a protein sequence encoded by SEQ ID NO: 6.

SEQ ID NO: 8 is an MEF1 codon-deoptimized nucleic acid sequence.

SEQ ID NO: 9 is a capsid nucleic acid coding sequence of FMDV.

SEQ ID NO: 10 is a protein sequence encoded by SEQ ID NO: 9.

SEQ ID NO: 11 is an FMDV codon-deoptimized capsid nucleic acid sequence.

SEQ ID NO: 12 is a spike glycoprotein nucleic acid coding sequence of SARS coronavirus.

SEQ ID NO: 13 is a protein sequence encoded by SEQ ID NO: 12.

SEQ ID NO: 14 is a SARS coronavirus codon-deoptimized spike glycoprotein nucleic acid sequence.

SEQ ID NO: 15 is a nucleic acid coding sequence of rubella virus.

SEQ ID NOS: 16 and 17 are protein sequences encoded by SEQ ID NO: 15.

SEQ ID NO: 18 is a rubella codon-deoptimized nucleic acid sequence.

SEQ ID NO: 19 is a gH nucleic acid coding sequence of VZV.

SEQ ID NO: 20 is a protein sequence encoded by SEQ ID NO: 18.

SEQ ID NO: 21 is a VZV codon-deoptimized gH nucleic acid sequence.

SEQ ID NO: 22 is a gE nucleic acid coding sequence of VZV.

SEQ ID NO: 23 is a protein sequence encoded by SEQ ID NO: 21.

SEQ ID NO: 24 is a VZV codon-deoptimized gE nucleic acid sequence.

SEQ ID NO: 25 is an F nucleic acid coding sequence of measles virus.

SEQ ID NO: 26 is a protein sequence encoded by SEQ ID NO: 24.

SEQ ID NO: 27 is a measles virus codon-deoptimized F nucleic acid sequence.

SEQ ID NO: 28 is a hemagglutinin (H) nucleic acid coding sequence of measles virus.

SEQ ID NO: 29 is a protein sequence encoded by SEQ ID NO: 27.

SEQ ID NO: 30 is a measles codon-deoptimized H nucleic acid sequence.

SEQ ID NO: 31 is an F nucleic acid coding sequence of RSV.

SEQ ID NO: 32 is a protein sequence encoded by SEQ ID NO: 30.

SEQ ID NO: 33 is a RSV codon-deoptimized F nucleic acid sequence.

SEQ ID NO: 34 is a G nucleic acid coding sequence of RSV.

SEQ ID NO: 35 is a protein sequence encoded by SEQ ID NO: 33.

SEQ ID NO: 36 is a RSV codon-deoptimized G nucleic acid sequence.

SEQ ID NO: 37 is a HA nucleic acid coding sequence of influenza virus.

SEQ ID NO: 38 is a protein sequence encoded by SEQ ID NO: 36.

SEQ ID NO: 39 is an influenza virus codon-deoptimized HA nucleic acid sequence.

SEQ ID NO: 40 is a NA nucleic acid coding sequence of influenza virus.

SEQ ID NO: 41 is a protein sequence encoded by SEQ ID NO: 39.

SEQ ID NO: 42 is an influenza codon-deoptimized NA nucleic acid sequence.

SEQ ID NO: 43 is an env nucleic acid coding sequence of HIV-1.

SEQ ID NO: 44 is a protein sequence encoded by SEQ ID NO: 42.

SEQ ID NO: 45 is an HIV-1 codon-deoptimized env nucleic acid sequence.

SEQ ID NO: 46 is an ArgS nucleic acid coding sequence of E. coli.

SEQ ID NO: 47 is a protein sequence encoded by SEQ ID NO: 45.

SEQ ID NO: 48 is an E. coli codon-deoptimized ArgS nucleic acid sequence.

SEQ ID NO: 49 is an TufA nucleic acid coding sequence of E. coli.

SEQ ID NO: 50 is a protein sequence encoded by SEQ ID NO: 48.

SEQ ID NO: 51 is an E. coli codon-deoptimized TufA nucleic acid sequence.

SEQ ID NO: 52 is a nucleic acid sequence showing the sequence of MEF1R1 or uncloned.

SEQ ID NO: 53 is a nucleic acid sequence showing the sequence of MEF1R2.

SEQ ID NO: 54 is a nucleic acid sequence showing the sequence of MEF1R5.

SEQ ID NO: 55 is a nucleic acid sequence showing the sequence of MEF1R6.

SEQ ID NO: 56 is a nucleic acid sequence showing the sequence of MEF1R7.

SEQ ID NO: 57 is a nucleic acid sequence showing the sequence of MEF1R8.

SEQ ID NO: 58 is a nucleic acid sequence showing the sequence of MEF1R9.

SEQ ID NOS: 59-60 are primer sequences used to amplify the $3D^{pol}$ region of Sabin 2.

SEQ ID NO: 61 is a TaqMan probe used to detect the yield of amplicon generated using SEQ ID NOS: 59 and 60.

SEQ ID NOS: 62-63 are primer sequences used to amplify the $3D^{pol}$ region of MEF1.

SEQ ID NO: 64 is a TaqMan probe used to detect the yield of amplicon generated using SEQ ID NOS: 62 and 63.

SEQ ID NO: 65 is a Sabin 2 cassette d (VP1 region) sequence with a reduced number of CG dinucleotides.

SEQ ID NO: 66 is a Sabin 2 cassette d (VP1 region) sequence with a reduced number of CG and TA dinucleotides.

SEQ ID NO: 67 is a Sabin 2 cassette d (VP1 region) sequence with an increased number of CG dinucleotides.

SEQ ID NO: 68 is a Sabin 2 cassette d (VP1 region) sequence with an increased number of CG and TA dinucleotides.

SEQ ID NO: 69 is an exemplary deoptimized Sabin 2 cassette d (VP1 region) sequence.

SEQ ID NO: 70 is a Sabin 2 cassette d (VP1 region) sequence that uses MEF1 codons for Sabin 2 amino acids.

DETAILED DESCRIPTION OF SEVERAL EMBODIMENTS

Abbreviations and Terms

The following explanations of terms and methods are provided to better describe the present disclosure and to guide those of ordinary skill in the art in the practice of the present disclosure. The singular forms "a," "an," and "the" refer to one or more than one, unless the context clearly dictates otherwise. For example, the term "comprising a nucleic acid molecule" includes single or plural nucleic acid molecules and is considered equivalent to the phrase "comprising at least one nucleic acid molecule." The term "or" refers to a single element of stated alternative elements or a combination of two or more elements, unless the context clearly indicates otherwise. As used herein, "comprises" means "includes." Thus, "comprising an alteration in the number of TA or CG dinucleotides," means "including an alteration in the number of TA dinucleotides, the number of CG dinucleotides, or the number of CG and TA dinucleotides," without excluding additional elements.

Unless explained otherwise, all technical and scientific terms used herein have the same meaning as commonly understood to one of ordinary skill in the art to which this disclosure belongs. Although methods and materials similar or equivalent to those described herein can be used in the practice or testing of the present disclosure, suitable methods and materials are described below. The materials, methods, and examples are illustrative only and not intended to be limiting.

OPV: oral poliovirus vaccine

PV: poliovirus

VAPP: vaccine-associated paralytic poliomyelitis

VDPV: vaccine-derived poliovirus

Adjuvant: A compound, composition, or substance that when used in combination with an immunogenic agent augments or otherwise alters or modifies a resultant immune response. In some examples, an adjuvant increases the titer of antibodies induced in a subject by the immunogenic agent. In another example, if the antigenic agent is a multivalent antigenic agent, an adjuvant alters the particular epitopic sequences that are specifically bound by antibodies induced in a subject.

Exemplary adjuvants include, but are not limited to, Freund's Incomplete Adjuvant (IFA), Freund's complete adjuvant, B30-MDP, LA-15-PH, montanide, saponin, aluminum salts such as aluminum hydroxide (Amphogel, Wyeth Laboratories, Madison, N.J.), alum, lipids, keyhole limpet protein, hemocyanin, the MF59 microemulsion, a mycobacterial antigen, vitamin E, non-ionic block polymers, muramyl dipeptides, polyanions, amphipatic substances, ISCOMs (immune stimulating complexes, such as those disclosed in European Patent EP 109942), vegetable oil, Carbopol, aluminium oxide, oil-emulsions (such as Bayol F or Marcol 52), *E. coli* heat-labile toxin (LT), *Cholera* toxin (CT), and combinations thereof.

In one example, an adjuvant includes a DNA motif that stimulates immune activation, for example the innate immune response or the adaptive immune response by T-cells, B-cells, monocytes, dendritic cells, and natural killer cells. Specific, non-limiting examples of a DNA motif that stimulates immune activation include CG oligodeoxynucleotides, as described in U.S. Pat. Nos. 6,194,388; 6,207,646; 6,214,806; 6,218,371; 6,239,116; 6,339,068; 6,406,705; and 6,429,199, and IL-2 or other immunomodulators.

Administration: To provide or give a subject an agent, such as an immunogenic composition disclosed herein, by any effective route. Exemplary routes of administration include, but are not limited to, oral, injection (such as subcutaneous, intramuscular, intradermal, intraperitoneal, and intravenous), sublingual, rectal, transdermal, intranasal, vaginal, intraocular, and inhalation routes.

Agent: Any substance, including, but not limited to, a chemical compound, molecule, peptidomimetic, pathogen, or protein.

Antibody: A molecule including an antigen binding site which specifically binds (immunoreacts with) an antigen. Examples include polyclonal antibodies, monoclonal antibodies, humanized monoclonal antibodies, or immunologically effective portions thereof.

Includes immunoglobulin molecules and immunologically active portions thereof. Immunoglobulin genes include the kappa, lambda, alpha, gamma, delta, epsilon, and mu constant region genes, as well as the myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively.

Antigen: A compound, composition, or substance that can stimulate the production of antibodies or a T-cell response in an animal, including compositions that are injected or absorbed into an animal. An antigen reacts with the products of specific humoral or cellular immunity, including those induced by heterologous immunogens. The term "antigen" includes all related antigenic epitopes. In one example, an antigen is an attenuated pathogen.

Attenuated pathogen: A pathogen with a decreased or weakened ability to produce disease while retaining the ability to stimulate an immune response like that of the natural pathogen. In one example, a live pathogen is attenuated by deoptimizing one or more codons in one or more genes, such as an immunogenic surface antigen or a housekeeping gene. In another example, a pathogen is attenuated by selecting for avirulent variants under certain growth conditions (for example see Sabin and Boulger. *J. Biol. Stand.* 1:115-8; 1973; Sutter et al., 2003. Poliovirus vaccine—live, p. 651-705. In S. A. Plotkin and W. A. Orenstein (ed.), Vaccines, Fourth ed. W.B. Saunders Company, Philadelphia).

Codons can be deoptimized, for example, by manipulating the nucleic acid sequence using molecular biology methods. Attenuated pathogens, such as an attenuated virus or bacterium, can be used in an immune composition to stimulate an immune response in a subject. For example, attenuated pathogens can be used in an attenuated vaccine to produce an immune response without causing the severe effects of the disease. Particular examples of attenuated vaccines include, but are not limited to, measles, mumps, rubella, polio, typhoid, yellow fever, and varicella vaccines.

cDNA (complementary DNA): A piece of DNA lacking internal, non-coding segments (introns) and regulatory sequences that determine transcription. cDNA can be synthesized in the laboratory by reverse transcription from messenger RNA or viral extracted from cells or purified viruses.

Cellular immunity: An immune response mediated by cells or the products they produce, such as cytokines, rather than by an antibody. It includes, but is not limited to, delayed type hypersensitivity and cytotoxic T cells.

CG dinucleotide: A cytosine nucleotide immediately followed by a guanine in a nucleic acid sequence. Similarly, a TA (or UA) dinucleotide is a thymine (or uracil) nucleotide immediately followed by a adenine in a nucleic acid sequence. For example, the sequence GT<u>CG</u>ACT (nucleotides 1-10 of SEQ ID NO: 2) has one CG dinucleotide and one TA dinucleotide (underlined).

Codon: A specific sequence of three adjacent nucleotide bases on a strand of DNA or RNA that provides genetic code information for a particular amino acid or a termination signal.

Conservative substitution: One or more amino acid substitutions for amino acid residues having similar biochemical properties. Typically, conservative substitutions have little to no impact on the activity of a resulting polypeptide. For example, a conservative substitution is an amino acid substitution in an antigenic epitope of a pathogenic peptide that does not substantially affect the ability of an antibody that specifically binds to the unaltered epitope to specifically bind the epitope including the conservative substitution. Thus, in some examples, a conservative variant of an epitope is also a functional variant of the epitope.

Methods which can be used to determine the amount of recognition by a variant epitope are disclosed herein. In addition, an alanine scan can be used to identify which amino acid residues in a pathogenic epitope can tolerate an amino acid substitution. In one example, recognition is not decreased by more than 25%, for example not more than 20%, for example not more than 10%, when an alanine, or other conservative amino acid (such as those listed below), is substituted for one or more native amino acids. Similarly, an ELISA assay can be used that compares a level of specific binding of an antibody that specifically binds a particular antigenic peptide to a level of specific binding of the antibody to a corresponding peptide with the substitution(s) to determine if the substitution(s) does not substantially affect specific binding of the substituted peptide to the antibody.

In one example, one, two, three, five, or ten conservative substitutions are included in the peptide. In another example, 1-10 conservative substitutions are included in the peptide. In a further embodiment, at least 2 conservative substitutions are included in the peptide. A peptide can be produced to contain one or more conservative substitutions by manipulating the nucleotide sequence that encodes that polypeptide using, for example, standard procedures such as site-directed mutagenesis or PCR. Alternatively, a polypeptide can be produced to contain one or more conservative substitutions by using standard peptide synthesis methods.

Substitutional variants are those in which at least one residue in the amino acid sequence has been removed and a different residue inserted in its place. Conservative substitution tables providing functionally similar amino acids are well known in the art. Examples of amino acids which may be substituted for an original amino acid in a protein and which are regarded as conservative substitutions include: Ser for Ala; Lys for Arg; Gln or His for Asn; Glu for Asp; Ser for Cys; Asn for Gln; Asp for Glu; Pro for Gly; Asn or Gln for His; Leu or Val for Ile; Ile or Val for Leu; Arg or Gln for Lys; Leu or Ile for Met; Met, Leu or Tyr for Phe; Thr for Ser; Ser for Thr; Tyr for Trp; Trp or Phe for Tyr; and Ile or Leu for Val.

Further information about conservative substitutions can be found, among other sources, Ben-Bassat et al., (*J. Bacteriol.* 169:751-7, 1987), O'Regan et al., (*Gene* 77:237-51, 1989), Sahin-Toth et al., (*Protein Sci.* 3:240-7, 1994), Hochuli et al., (*Bio/Technology* 6:1321-5, 1988) and in standard textbooks of genetics and molecular biology.

DNA (deoxyribonucleic acid): A long chain polymer which includes the genetic material of most living organisms (many viruses have genomes containing only ribonucleic acid, RNA). The repeating units in DNA polymers are four different nucleotides, each of which includes one of the four bases, adenine, guanine, cytosine and thymine bound to a deoxyribose sugar to which a phosphate group is attached. Triplets of nucleotides, referred to as codons, in DNA molecules code for amino acid in a polypeptide. The term codon is also used for the corresponding (and complementary) sequences of three nucleotides in the mRNA into which the DNA sequence is transcribed.

Degenerate variant: A nucleic acid sequence encoding a peptide that includes a sequence that is degenerate as a result of the genetic code. There are 20 natural amino acids, most of which are specified by more than one of the 61 codons of the "universal" genetic code used by most cells and viruses. For example, the amino acid Ala is encoded by four codon triplets: GCU, GCG, GCA, and GCC. Therefore, all degenerate nucleotide sequences are included as long as the amino acid sequence of the peptide encoded by the nucleotide sequence is unchanged.

Deoptimization of a codon: To replace a preferred codon in a nucleic acid sequence with a synonymous codon (one that codes for the same amino acid) less frequently used (unpreferred) in the organism. Each organism has a particular codon usage bias for each amino acid, which can be determined from publicly available codon usage tables (for example see Nakamura et al., *Nucleic Acids Res.* 28:292, 2000 and references cited therein; Sharp et al., *Nucleic Acids Res.* 16:8207-11, 1988; Chou and Zhang, *AIDS Res. Hum. Retroviruses*. December; 8(12):1967-76, 1992; West and Iglewski et al., *Nucleic Acids Res.* 16:9323-35, 1988; Rothberg and Wimmer, *Nucleic Acids Res.* 9:6221-9, 1981; Jenkins et al., *J. Mol. Evol.* 52:383-90, 2001; and Watterson, *Mol. Biol. Evol.* 9:666-77, 1992; all herein incorporated by reference). In addition, codon usage tables are available for several organisms on the internet at GenBank's website.

For example, if an organism has a codon usage for the amino acid Val of 15% for GUU, 10% for GUC, 50% for GUA, and 25% for GUG, the "least frequently used codon" is GUC. Therefore, to deoptimize a Val codon, the codon GUC could be used to replace one or more of the codons GUU, GUA, or GUG in a native sequence. Similarly, the codon GUU is a "less frequently used codon" than the GUA codon, and therefore, GUU could be used to replace GUA.

In some examples, the choice of the less frequently used codon is made depending on whether the codon will alter the G+C content, the number of CG dinucleotides, the number of TA(UA) dinucleotides, or combinations thereof, in the deoptimized sequence. For example, if an organism has a codon usage for the amino acid Val of 50% for GUU, 10% for GUC, 15% for GUA, and 25% for GUG, the codon GUA is a "less frequently used codon" than the GUU codon, and could be used to replace GUU, for example if it was desired to increase the number of UA (TA) dinucleotides in the deoptimized sequence. Similarly, the codon GUG is a "less frequently used codon" than the GUU codon, and could be used to replace GUU, for example if it was desired to increase the G+C content of the deoptimized sequence.

Deoptimized pathogen: A pathogen having a nucleic acid coding sequence with one or more deoptimized codons, which decrease the replicative fitness of the pathogen. In some examples, refers to the isolated deoptimized nucleic acid sequence itself, independent of the pathogenic organism.

Epitope: An antigenic determinant. Chemical groups or peptide sequences on a molecule that are antigenic, that is, that elicit a specific immune response. An antibody binds a particular antigenic epitope, or a T-cell reacts with a particular antigenic epitope bound to a specific MHC molecule. In some examples, an epitope has a minimum sequence of 6-8 amino acids, and a maximum sequence of about 100 amino acids, for example, about 50, 25 or 18 amino acids in length.

Functional variant: Sequence alterations in a peptide, wherein the peptide with the sequence alterations retains a function or property (such as immunogenicity) of the unaltered peptide. For example, a functional variant of an epitope can specifically bind an antibody that binds an unaltered form of the epitope or stimulates T-cell proliferation to an extent that is substantially the same as the unaltered form of the epitope. Sequence alterations that provide functional variants can include, but are not limited to, conservative substitutions, deletions, mutations, frameshifts, and insertions. Assays for determining antibody binding and T-cell reactivity are well known in the art.

Screens for immunogenicity can be performed using well known methods such as those described in Harlow and Lane, *Antibodies: A Laboratory Manual*, Cold Spring Harbor Laboratory, 1988, or in Paul, *Fundamental Immunology*, 3rd ed., 243-247 (Raven Press, 1993) and references cited therein. For example, a peptide can be immobilized on a solid support and contacted with subject sera to allow binding of antibodies within the sera to the immobilized polypeptide. Unbound sera may then be removed and bound antibodies detected using, for example, $^{125}$I-labeled Protein A. The ability of a functional variant to react with antigen-specific antisera may be unchanged relative to original epitope, or may be enhanced or diminished by less than 30%, for example, less than 20%, such as less than 10%, relative to the unaltered epitope.

G+C content: The amount of guanine (G) and cytosine (C) in a nucleic acid sequence (such as a pathogen coding sequence). In particular examples, the amount can be expressed in mole fraction or percentage of total number of bases in the sequence. For example, the sequence GTAGTCGACT (nucleotides 1-10 of SEQ ID NO: 2) would be said to have a G+C content of 50% (5 of the 10 bases are guanine and cytosine).

Humoral immunity: Immunity that can be transferred with immune serum from one subject to another. Typically, humoral immunity refers to immunity resulting from the introduction of specific antibodies or stimulation of the production of specific antibodies, for example by administration of one or more of the pathogens with decreased replicative fitness disclosed herein.

Hybridization: The binding of a nucleic acid molecule to another nucleic acid molecule, for example the binding of a single-stranded DNA or RNA to another nucleic acid, thereby forming a duplex molecule. The ability of one nucleic acid molecule to bind to another nucleic acid molecule can depend upon the complementarity between the nucleotide sequences of two nucleic acid molecules, and the stringency of the hybridization conditions.

Methods of performing hybridization are known in the art (such as those described in sections 7.39-7.52 of Sambrook et al., (1989) Molecular Cloning, second edition, Cold Spring Harbor Laboratory, Plainview, N.Y.). For example, Southern or Northern analysis can be used to determine if one nucleic acid sequence hybridizes to another nucleic acid sequence.

Deoptimized nucleic acid molecules are disclosed herein, such as SEQ ID NOs: 5, 8, 11, 14, 18, 21, 24, 27, 30, 33, 36, 39, 42, 45, 48, 51, 54, 55, 56, 57, 58, 67, 68, and 69. However, the present disclosure encompasses other deoptimized nucleic acid molecules that can hybridize to any of SEQ ID NOs: 5, 8, 11, 14, 18, 21, 24, 27, 30, 33, 36, 39, 42, 45, 48, 51, 54, 55, 56, 57, 58, 67, 68, or 69, under moderate or high stringent conditions. In some examples, sequences that can hybridize to any of SEQ ID NOs: 5, 8, 11, 14, 18, 21, 24, 27, 30, 33, 36, 39, 42, 45, 48, 51, 54, 55, 56, 57, 58, 67, 68, or 69 are at least 100 nucleotides in length (such as at least 500, at least 750, at least 1000, at least 2500, or at least 5000 nucleotides in length) and hybridize, under moderate or high hybridization conditions, to the sense or antisense strand of any of SEQ ID NOs: 5, 8, 11, 14, 18, 21, 24, 27, 30, 33, 36, 39, 42, 45, 48, 51, 54, 55, 56, 57, 58, 67, 68, or 69.

Moderately stringent hybridization conditions are when the hybridization is performed at about 42° C. in a hybridization solution containing 25 mM $KPO_4$ (pH 7.4), 5×SSC, 5× Denhart's solution, 50 μg/mL denatured, sonicated salmon sperm DNA, 50% formamide, 10% Dextran sulfate, and 1-15 ng/mL probe (about $5\times10^7$ cpm/μg), while the washes are performed at about 50° C. with a wash solution containing 2×SSC and 0.1% sodium dodecyl sulfate.

Highly stringent hybridization conditions are when the hybridization is performed at about 42° C. in a hybridization solution containing 25 mM $KPO_4$ (pH 7.4), 5×SSC, 5×Denhart's solution, 50 μg/mL denatured, sonicated salmon sperm DNA, 50% formamide, 10% Dextran sulfate, and 1-15 ng/mL probe (about $5\times10^7$ cpm/μg), while the washes are performed at about 65° C. with a wash solution containing 0.2×SSC and 0.1% sodium dodecyl sulfate.

Immune response: A response of a cell of the immune system, such as a B-cell, T-cell, macrophage, monocyte, or polymorphonucleocyte, to an immunogenic agent (such as the disclosed pathogens having decreased replicative fitness or sequences therefrom) in a subject. An immune response can include any cell of the body involved in a host defense response, such as an epithelial cell that secretes interferon or a cytokine. An immune response includes, but is not limited to, an innate immune response or inflammation.

The response can be specific for a particular antigen (an "antigen-specific response"). In a particular example, an immune response is a T cell response, such as a CD4+ response or a CD8+ response. In another example, the response is a B cell response, and results in the production of specific antibodies to the immunogenic agent.

In some examples, such an immune response provides protection for the subject from the immunogenic agent or the source of the immunogenic agent. For example, the response can protect a subject, such as a human or veterinary subject, from infection by a pathogen, or interfere with the progression of an infection by a pathogen. An immune response can be active and involve stimulation of the subject's immune system, or be a response that results from passively acquired immunity.

Immunity: The state of being able to mount a protective response upon exposure to an immunogenic agent (such as the disclosed pathogens having decreased replicative fitness or sequences therefrom). Protective responses can be antibody-mediated or immune cell-mediated, and can be directed toward a particular pathogen. Immunity can be acquired actively (such as by exposure to an immunogenic agent, either naturally or in a pharmaceutical composition) or passively (such as by administration of antibodies).

Immunogen: An agent (such as a compound, composition, or substance) that can stimulate or elicit an immune response by a subject's immune system, such as stimulating the production of antibodies or a T-cell response in a subject. Immunogenic agents include, but are not limited to, pathogens (such as the disclosed pathogens having decreased replicative fitness or sequences therefrom) and their corresponding proteins. One specific example of an immunogenic composition is a vaccine.

Immunogenic carrier: An immunogenic macromolecule to which an antigenic molecule (such as a pathogen with decreased replicative fitness) is bound. When bound to a carrier, the bound molecule becomes more immunogenic, such as an increase of at least 5%, at least 10%, at least 20%, or even at least 50%. Carriers can be used to increase the immunogenicity of the bound molecule or to elicit antibodies against the carrier which are diagnostically, analytically, or therapeutically beneficial. Covalent linking of a molecule to a carrier confers enhanced immunogenicity and T-cell dependence (Pozsgay et al., *PNAS* 96:5194-97, 1999; Lee et al., *J. Immunol.* 116:1711-18, 1976; Dintzis et al., *PNAS* 73:3671-75, 1976). Exemplary carriers include polymeric carriers, which can be natural (for example, polysaccharides, polypeptides or proteins from bacteria or viruses), semi-synthetic or synthetic materials containing one or more functional groups to which a reactant moiety can be attached.

Examples of bacterial products for use as carriers include, but are not limited to, bacterial toxins, such as *B. anthracis* PA (including fragments that contain at least one antigenic epitope and analogs or derivatives capable of eliciting an immune response), LF and LeTx, and other bacterial toxins and toxoids, such as tetanus toxin/toxoid, diphtheria toxin/toxoid, *P. aeruginosa* exotoxin/toxoid/, pertussis toxin/toxoid, and *C. perfringens* exotoxin/toxoid. Viral proteins, such as hepatitis B surface antigen and core antigen can also be used as carriers, as well as proteins from higher organisms such as keyhole limpet hemocyanin, horseshoe crab hemocyanin, edestin, mammalian serum albumins, and mammalian immunoglobulins. Additional bacterial products for use as carriers include, but are not limited to, bacterial wall proteins and other products (for example, streptococcal or staphylococcal cell walls and lipopolysaccharide (LPS)).

Immunogenicity: The ability of an agent to induce a humoral or cellular immune response. Immunogenicity can be measured, for example, by the ability to bind to an appropriate MHC molecule (such as an MHC Class I or II molecule) and to induce a T-cell response or to induce a B-cell or antibody response, for example, a measurable cytotoxic T-cell response or a serum antibody response to a given epitope. Immunogenicity assays are well-known in the art and are described, for example, in Paul, *Fundamental Immunology*, 3rd ed., 243-247 (Raven Press, 1993) and references cited therein.

Immunologically Effective Dose: A therapeutically effective amount of an immunogen (such as the disclosed pathogens having decreased replicative fitness or sequences therefrom) that will prevent, treat, lessen, or attenuate the severity, extent or duration of a disease or condition, for example, infection by a pathogen.

Isolated: An "isolated" biological component (such as, a nucleic acid molecule or protein) has been substantially separated, produced apart from, or purified away from other biological components in the cell of the organism in which the component occurs, for example, other chromosomal and extra-chromosomal DNA and RNA, and proteins. Nucleic acid molecules and proteins which have been "isolated" include nucleic acid molecules and proteins purified by standard purification methods. The term also embraces nucleic acid molecules and proteins prepared by recombinant expression in a host cell as well as chemically synthesized proteins and nucleic acids. Samples of isolated biological components include samples of the biological component wherein the biological component represents greater than 90% (for example, greater than 95%, such as greater than 98%) of the sample.

An "isolated" microorganism (such as a virus, bacterium, fungus, or protozoa) has been substantially separated or purified away from microorganisms of different types, strains, or species. Microorganisms can be isolated by a variety of techniques, including serial dilution and culturing.

Lymphocytes: A type of white blood cell involved in the immune defenses of the body. There are two main types of lymphocytes: B-cells and T-cells.

Mimetic: A molecule (such as an organic chemical compound) that mimics the activity of another molecule.

Nucleic acid molecule: A deoxyribonucleotide or ribonucleotide polymer including, without limitation, cDNA, mRNA, genomic DNA, genomic RNA, and synthetic (such as chemically synthesized) DNA. Includes nucleic acid sequences that have naturally-occurring, modified, or non-naturally-occurring nucleotides linked together by naturally-occurring or non-naturally-occurring nucleotide linkages. Nucleic acid molecules can be modified chemically or biochemically and can contain non-natural or derivatized nucleotide bases. Such modifications include, for example, labels, methylation, substitution of one or more of the naturally occurring nucleotides with analogs, and internucleotide linkage modifications.

Nucleic acid molecules can be in any topological conformation, including single-stranded, double-stranded, partially duplexed, triplexed, hairpinned, circular, linear, and padlocked conformations. Where single-stranded, a nucleic acid molecule can be the sense strand or the antisense strand. Also included are synthetic molecules that mimic polynucleotides in their ability to bind to a designated sequence via hydrogen bonding and other chemical interactions. Such molecules are known and include, for example, molecules in which peptide linkages are substituted for phosphate linkages in the backbone.

The disclosure includes isolated nucleic acid molecules that include specified lengths of a nucleotide sequence. Such molecules can include at least 10, at least 15, at least 20, at least 25, at least 30, at least 35, at least 40, at least 45, at least 50, at least 100, at least 300 or at least 500 nucleotides of these sequences or more, and can be obtained from any region of a nucleic acid molecule.

Nucleotide: A subunit of DNA or RNA including a nitrogenous base (adenine, guanine, thymine, or cytosine in DNA; adenine, guanine, uracil, or cytosine in RNA), a phosphate molecule, and a sugar molecule (deoxyribose in DNA and ribose in RNA).

Passive immunity: Immunity acquired by the introduction by immune system components into a subject rather than by stimulation.

Pathogen: A disease-producing agent. Examples include, but are not limited to microbes such as viruses, bacteria, fungi, and protozoa.

Peptide, polypeptide, and protein: Polymers of amino acids (typically L-amino acids) or amino acid mimetics linked through peptide bonds or peptide bond mimetic to form a chain. The terminal amino acid at one end of the chain typically has a free amino group (the amino-terminus), while the terminal amino acid at the other end of the chain typically has a free carboxyl group (the carboxy terminus). Encompasses any amino acid sequence and includes modified sequences such as glycoproteins. The terms cover naturally occurring proteins, as well as those which are recombinantly or synthetically produced.

As used herein, the terms are interchangeable since they all refer to polymers of amino acids (or their analogs) regardless of length. Non-natural combinations of naturally- or non-naturally occurring sequences of amino acids may also be referred to as "fusion proteins."

Pharmaceutically Acceptable Carriers: The pharmaceutically acceptable carriers (vehicles) useful in this disclosure are conventional. *Remington's Pharmaceutical Sciences*, by E. W. Martin, Mack Publishing Co., Easton, Pa., 15th Edition (1975), describes compositions and formulations suitable for pharmaceutical delivery of one or more therapeutic compounds or molecules, such as one or more nucleic acid molecules, proteins or immunogenic compositions disclosed herein.

In general, the nature of the carrier will depend on the particular mode of administration being employed. For instance, parenteral formulations can include injectable fluids that include pharmaceutically and physiologically acceptable fluids such as water, physiological saline, balanced salt solutions, aqueous dextrose, glycerol or the like as a vehicle. In addition to biologically-neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate, sodium lactate, potassium chloride, calcium chloride, and triethanolamine oleate.

Poliovirus (PV): An enterovirus of the Picornaviridae family that is the causative agent of poliomyelitis (polio).

Purified: The term purified does not require absolute purity; rather, it is intended as a relative term. Thus, for example, a purified peptide preparation is one in which the peptide is more enriched than the peptide is in its natural environment within a cell or cell extract. In one example, a preparation is purified such that the purified peptide represents at least 50% of the total peptide content of the preparation. In other examples, a peptide is purified to represent at least 90%, such as at least 95%, or even at least 98%, of all macromolecular species present in a purified preparation prior to admixture with other formulation ingredients, such as a pharmaceutical carrier, excipient, buffer, absorption enhancing agent, stabilizer, preservative, adjuvant or other co-ingredient. In some examples, the purified preparation is be essentially homogeneous, wherein other macromolecular species are not detectable by conventional techniques.

Such purified preparations can include materials in covalent association with the active agent, such as glycoside residues or materials admixed or conjugated with the active agent, which may be desired to yield a modified derivative or analog of the active agent or produce a combinatorial therapeutic formulation, conjugate, fusion protein or the like. The term purified thus includes such desired products as peptide and protein analogs or mimetics or other biologically active compounds wherein additional compounds or moieties are bound to the active agent in order to allow for the attachment of other compounds or provide for formulations useful in therapeutic treatment or diagnostic procedures.

Quantitating: Determining a relative or absolute quantity of a particular component in a sample. For example, in the context of quantitating antibodies in a sample of a subject's blood to detect infection by a pathogen, quantitating refers to determining the quantity of antibodies using an antibody assay, for example, an ELISA-assay or a T-cell proliferation assay.

Recombinant: A recombinant nucleic acid molecule is one that has a sequence that is not naturally occurring or has a sequence that is made by an artificial combination of two otherwise separated segments of sequence. This artificial combination can be accomplished by chemical synthesis or by the artificial manipulation of isolated segments of nucleic acids, for example, by genetic engineering techniques such as those described in Sambrook et al. (ed.), *Molecular Cloning: A Laboratory Manual*, $2^{nd}$ ed., vol. 1-3, Cold Spring Harbor Laboratory Press, Cold Spring Harbor, N.Y., 1989. The term recombinant includes nucleic acid molecules that have been altered solely by addition, substitution, or deletion of a portion of the nucleic acid molecule. Similarly, a recombinant protein is one encoded for by a recombinant nucleic acid molecule.

Replicative fitness: The ability of a pathogen to produce mature infectious progeny. In some examples, introduction of one or more deoptimized codons into a pathogen reduces the replicative fitness of the pathogen, as compared to a pathogen containing native codons. In particular examples, introduction of one or more deoptimized codons into a pathogen, in combination with altering the G+C content or altering the number of CG or TA dinucleotides in a coding sequence, reduces the replicative fitness of the pathogen, as compared to a pathogen containing native codons. In some examples, such replicative fitness is reduced by at least 10%, such as at least 20%, at least 50%, or even at least 90% as compared to a pathogen containing native codons.

Methods that can be used to determine replicative fitness are disclosed herein and are known in the art. For example, to determine the replicative fitness of a virus, plaque size can be determined, infectious center assays can be used, viral titer by TCID50 (tissue-culture infectious doses 50%) or plaque assay, replication in single-step growth curves, temperature-sensitivity or cold-sensitivity of plaques determined, unusual host range observed, or competition assays with a related virus can be determined. To determine the replicative fitness of a bacterium or fungus, exemplary replicative fitness assays include assays for colony-forming activity, temperature-sensitivity, cold-sensitivity, slow growth under certain conditions, increased or rapid bacterial death, reduced ability of the bacteria or fungi to survive various stress conditions (such as nutrient deprivation), altered host range, enzymatic assays indicating reduced activity of a key enzyme, or assays for reduced pathogenicity due to decreased expression of an important protein (such as LPS).

Specific Binding Agent: An agent that binds substantially only to a defined target. Thus a protein-specific binding agent binds substantially only the defined protein, or to a specific region within the protein. As used herein, a specific binding agent includes antibodies and other agents that bind substantially to a specified peptide.

The determination that a particular agent binds substantially only to a specific peptide can readily be made by using or adapting routine procedures. One suitable in vitro assay makes use of the Western blotting procedure (described in many standard texts, including Harlow and Lane, *Using Antibodies: A Laboratory Manual*, CSHL, New York, 1999).

Specifically bind: Refers to the ability of a particular agent (a "specific binding agent") to specifically react with a particular analyte, for example to specifically immunoreact with an antibody, or to specifically bind to a particular peptide sequence. The binding is a non-random binding reaction, for example between an antibody molecule and an antigenic determinant. Binding specificity of an antibody is typically determined from the reference point of the ability of the antibody to differentially bind the specific antigen and an unrelated antigen, and therefore distinguish between two different antigens, particularly where the two antigens have unique epitopes. An antibody that specifically binds to a particular epitope is referred to as a "specific antibody".

In particular examples, two compounds are said to specifically bind when the binding constant for complex formation between the components exceeds about $10^4$ L/mol, for example, exceeds about $10^6$ L/mol, exceeds about $10^8$ L/mol, or exceeds about $10^{10}$ L/mol. The binding constant for two components can be determined using methods that are well known in the art.

Subject: Living multi-cellular organisms, a category that includes human and non-human mammals, as well as other veterinary subjects such as fish and birds.

Therapeutically effective amount: An amount of a therapeutic agent (such as an immunogenic composition) that alone, or together with an additional therapeutic agent(s), induces the desired response, such as a protective immune response or therapeutic response to a pathogen. In one example, it is an amount of immunogen needed to increase resistance to, prevent, ameliorate, or treat infection and disease caused by a pathogenic infection in a subject. Ideally, a therapeutically effective amount of an immunogen is an amount sufficient to increase resistance to, prevent, ameliorate, or treat infection and disease caused by a pathogen without causing a substantial cytotoxic effect in the subject. The preparations disclosed herein are administered in therapeutically effective amounts.

In general, an effective amount of a composition administered to a human or veterinary subject will vary depending upon a number of factors associated with that subject, for example whether the subject previously has been exposed to the pathogen. An effective amount of a composition can be determined by varying the dosage of the product and measuring the resulting immune or therapeutic responses, such as the production of antibodies. Effective amounts also can be determined through various in vitro, in vivo or in situ immunoassays. The disclosed therapeutic agents can be administered in a single dose, or in several doses, as needed to obtain the desired response. However, the effective amount of can be dependent on the source applied, the subject being treated, the severity and type of the condition being treated, and the manner of administration.

The disclosed therapeutic agents can be administered alone, or in the presence of a pharmaceutically acceptable carrier, or in the presence of other agents, for example an adjuvant.

In one example, a desired response is to increase an immune response in response to infection with a pathogen. For example, the therapeutic agent can increase the immune response by a desired amount, for example by at least 5%, at least 10%, at least 15%, at least 20%, at least 25%, at least 30%, at least 50%, at least 75%, or even at least 90%, as compared to an immune response in the absence of the therapeutic agent. This increase can result in decreasing or slowing the progression of, a disease or condition associated with a pathogenic infection.

In another example, a desired response is to decrease the incidence of vaccine-associated paralytic poliomyelitis in response to an attenuated Sabin oral polio vaccine. The incidence of vaccine-associated paralytic poliomyelitis does not need to be completely eliminated for a therapeutic agent, such as a pharmaceutical preparation that includes an immunogen, to be effective. For example, the therapeutic agent (such as a codon-deoptimized oral polio vaccine) can decrease the incidence of vaccine-associated paralytic poliomyelitis or the emergence of circulating vaccine-derived polioviruses by a desired amount, for example by at least 5%, at least 10%, at least 15%, at least 20%, at least 25%, at least 30%, at least 50%, at least 75%, or even at least 90%, as compared to the incidence of vaccine-associated paralytic poliomyelitis or the emergence of circulating vaccine-derived polioviruses in the presence of a oral polio vaccine containing native codons.

Treating a disease: "Treatment" refers to a therapeutic intervention that ameliorates a sign or symptom of a disease or pathological condition related to a disease, even if the underlying pathophysiology is not affected. Reducing a sign or symptom associated with a pathogenic infection can be evidenced, for example, by a delayed onset of clinical symptoms of the disease in a susceptible subject, a reduction in severity of some or all clinical symptoms of the disease, a slower progression of the disease, a reduction in the number of relapses of the disease, an improvement in the overall health or well-being of the subject, or by other parameters well known in the art that are specific to the particular disease.

Treatment can also induce remission or cure of a condition, such as a pathogenic infection or a pathological condition associated with such an infection. In particular examples, treatment includes preventing a disease, for example by inhibiting or even avoiding altogether the full development of a disease or condition, such as a disease associated with a pathogen, such as polio. Thus, prevention of pathogenic disease can include reducing the number of subjects who acquire a disease associated with a pathogenic infection (such as the development of polio or poliomyelitis by the polio virus or development of rabies by the rabies virus) in a population of subjects receiving a preventative treatment (such as vaccination) relative to an untreated control population, or delaying the appearance of such disease in a treated population versus an untreated control population. Prevention of a disease does not require a total absence of disease. For example, a decrease of at least 50% can be sufficient.

Unit dose: A physically discrete unit containing a predetermined quantity of an active material calculated to individually or collectively produce a desired effect such as an immunogenic effect. A single unit dose or a plurality of unit doses can be used to provide the desired effect, such as an immunogenic effect. In one example, a unit dose includes a desired amount of one or more of the disclosed pathogens having reduced replicative fitness.

Vaccine: An immunogenic composition that can be administered to an animal or a human to confer immunity, such as active immunity, to a disease or other pathological condition. Vaccines can be used prophylactically or therapeutically. Thus, vaccines can be used reduce the likelihood of infection or to reduce the severity of symptoms of a disease or condition or limit the progression of the disease or condition. In one example, a vaccine includes one or more of the disclosed pathogens having reduced replicative fitness.

Vector: A nucleic acid molecule as introduced into a host cell, thereby producing a transformed host cell. A vector can include nucleic acid sequences that permit it to replicate in the host cell, such as an origin of replication. A vector can also include one or more therapeutic genes or selectable marker genes and other genetic elements known in the art. A vector can transduce, transform or infect a cell, thereby causing the cell to express nucleic acid molecules or proteins other than those native to the cell. A vector optionally includes materials to aid in achieving entry of the nucleic acid into the cell, such as a viral particle, liposome, protein coating or the like. In one example, a vector is a viral vector. Viral vectors include, but are not limited to, retroviral and adenoviral vectors.

Deoptimizing Codon Usage to Decrease Replicative Fitness

This disclosure provides methods of decreasing the replicative fitness of a pathogen by deoptimizing codon usage in one or more genes of the pathogen. Such methods can be used to increase the genetic stability of the attenuated phenotype of currently available attenuated vaccines, as well as to generate new attenuated pathogens that can be used in immunogenic compositions. For example, the attenuated Sabin oral polio vaccine (OPV) strains are genetically unstable. This instability is the underlying cause of vaccine-associated paralytic poliomyelitis and the emergence of circulating vaccine-derived polioviruses. Therefore, the disclosed compositions and methods can be used to reduce the incidence of vaccine-associated paralytic poliomyelitis and other disorders caused by currently available live attenuated vaccines. The disclosed methods and compositions increase the genetic stability of pathogens by distributing attenuating mutations over many sites within the pathogen's genome.

Codon usage bias, the use of synonymous codons at unequal frequencies, is ubiquitous among genetic systems (Ikemura, *J. Mol. Biol.* 146:1-21, 1981; Ikemura, *J. Mol. Biol.* 158:573-97, 1982). The strength and direction of codon usage bias is related to genomic G+C content and the relative abundance of different isoaccepting tRNAs (Akashi, *Curr. Opin. Genet. Dev.* 11:660-6, 2001; Duret, *Curr. Opin. Genet. Dev.* 12:640-9, 2002; Osawa et al., *Microbiol. Rev.* 56:229-64, 1992). Codon usage can affect the efficiency of gene expression. In *Escherichia coli* (Ikemura, *J. Mol. Biol.* 146:1-21, 1981; Xia *Genetics* 149:37-44, 1998), *Saccharomyces cerevisiae* (Bennetzen and Hall, *J. Biol. Chem.* 257:3026-31, 1982; Ikemura, *J. Mol. Biol.* 158:573-97, 1982), *Caenorhabditis elegans* (Duret, *Curr. Opin. Genet. Dev.* 12:640-9, 2002), *Drosophila melanogaster* (Moriyama and Powell, *J. Mol. Evol.* 45:514-23, 1997), and *Arabidopsis thaliana* (Chiapello et al. *Gene* 209:GC1-GC38, 1998) the most highly expressed genes use codons matched to the most abundant tRNAs (Akashi and Eyre-Walker, *Curr.*

Opin. Genet. Dev. 8:688-93, 1998). By contrast, in humans and other vertebrates, codon usage bias is more strongly correlated with the G+C content of the isochore where the gene is located (Musto et al., *Mol. Biol. Evol.* 18:1703-7, 2001; Urrutia and Hurst, *Genetics* 159:1191-9, 2001) than with the breadth or level of gene expression (Duret, *Curr. Opin. Genet. Dev.* 12:640-9, 2002) or the number of tRNA genes (Kanaya et al., *J. Mol. Evol.* 53:290-8, 2001).

The deoptimized nucleic acid sequences of the present application include one or more codons that are degenerate as a result of the genetic code. There are 20 natural amino acids, most of which are specified by more than one codon. However, organisms have codons which are used more frequently, and those that are used less frequently (deoptimized). All possible deoptimized nucleotide sequences are included in the disclosure as long as the deoptimized nucleotide sequence retains the ability to decrease replicative fitness, for example by at least 10%, at least 20%, at least 50% or even at least 75% as compared to the replicative fitness of a pathogen with a codon optimized nucleic acid sequence.

Optimization of codon composition is frequently required for efficient expression of genes in heterologous host systems (André et al., *J. Virol.* 72:1497-503, 1998; Kane, *Curr. Opin. Biotech.* 6:494-500, 1995; Smith, *Biotech. Prog.* 12:417-22, 1996; Yadava and Ockenhouse. *Infect. Immun.* 71:4961-9, 2003). Conversely, engineered codon deoptimization can dramatically decrease the efficiency of gene expression in several organisms (Robinson et al., *Nucleic Acids Res.* 12:6663-71, 1984; Hoekema et al., *Mol. Cell Biol.* 7:2914-24, 1987; Carlini and Stephan. *Genetics* 163: 239-43, 2003; and Zhou et al., *J. Virol.* 73:4972-82, 1999). However, it has not been previously taught or suggested that deoptimization of sequences of a microbial pathogen (such as a housekeeping or antigenic sequence) could be used to systematically reduce the replicative fitness of the pathogen, thereby producing a novel approach for developing attenuated derivatives of the pathogen having well-defined levels of replicative fitness, and increasing the genetic stability of the attenuated phenotype.

Selection of Codons to Deoptimize

The methods provided herein include deoptimizing at least one codon in a coding sequence of a pathogen, thereby generating a deoptimized coding sequence. Such deoptimization reduces replicative fitness of the pathogen. In particular examples, methods of reducing the replicative fitness of a pathogen include identifying one or more amino acids that are encoded by at least 2 different codons in the pathogen (such as 2 different codons, 3 different codons, 4 different codons, or 6 different codons). In some examples, the codon used least frequently (lowest codon usage frequency) for a particular amino acid is incorporated into the sequence of the pathogen (to replace the appropriate one or more codons in the native sequence), thereby deoptimizing the pathogen sequence and reducing the replicative fitness of the pathogen. In other examples, a codon used with a lower frequency than at least one other codon (but not necessarily the codon with the lowest frequency) for a particular amino acid is incorporated into the sequence of the pathogen (to replace the appropriate one or more codons in the native sequence), for example to alter the G+C content of the sequence or alter the number of CG or TA dinucleotides in the sequence, thereby deoptimizing the pathogen sequence and reducing the replicative fitness of the pathogen. Identification of infrequently used codons can be made by analyzing one or more codon usage tables for the pathogen. The codon usage table used can include codon usage data from the complete genome of the pathogen (or 2 or more genomes, for example from different strains of the pathogen), codon usage data from one or more genes (such as 1 gene, at least 2 genes, at least 3 genes, at least 5 genes, or even at least 10 genes), for example one or more genes involved in the antigenicity of the pathogen. Codon usage tables are publicly available for a wide variety of pathogens (for example see Nakamura et al., *Nucleic Acids Res.* 28:292, 2000; Sharp et al., *Nucleic Acids Res.* 16:8207-11, 1988; Chou and Zhang, *AIDS Res. Hum. Retroviruses*. December; 8(12):1967-76, 1992; West and Iglewski et al., *Nucleic Acids Res.* 16:9323-35, 1988, Rothberg and Wimmer, *Nucleic Acids Res.* 9:6221-9, 1981; Jenkins et al., *J. Mol. Evol.* 52:383-90, 2001; and Watterson, *Mol. Biol. Evol.* 9:666-77, 1992; all herein incorporated by reference).

For example, if the pathogen uses the ACU, ACC, ACA, and ACG codons to encode for Thr at 45, 24, 20 and 11% frequency respectively, the ACG codon can be chosen to replace at least one ACU, ACC, or ACA codon sequence of the native pathogen sequence, thereby generating a deoptimized sequence. This selection would also increase the number of CG dinucleotides in the deoptimized sequence. However, if it was desired to decrease the G+C content of the deoptimized sequence, the ACA codon (for example instead of ACG) can be chosen to replace the ACU codon. In examples where the amino acid is encoded by only two different codons, one of the two codons can be selected and used in the deoptimized sequence if the codon usage is highly biased, such as a difference of at least 10%, at least 20%, or at least 30%. For example, if the pathogen uses the codons UAU and UAC to encode for Tyr at 90% and 10% frequency respectively, the UAC codon is used to replace at least one UAU codon of the native pathogen sequence, thereby generating a deoptimized sequence. In contrast, if the pathogen uses the codons UAU and UAC to encode for Tyr at 49% and 51% frequency respectively, Tyr codons would not likely be chosen as the codons to deoptimize.

In some examples, there may be two or more codons used at low frequencies that are similar in value, such as codon usages that are within 0.01-2% of each other (for example within 0.1-2%, 0.5-2% or 1-2% of each other). In some examples, the codon with the lowest codon usage frequency is not chosen to replace a codon more frequently used. In some examples, the codon chosen is one that alters the G+C content of the deoptimized sequence. In other examples, the codon chosen is one that alters the frequency of a specific dinucleotide pair (such as CG or TA) found at low frequencies in that genome (such as no more than 3-4%). One example is the CG dinucleotide, which is strongly suppressed in mammalian genomes and in the genomes of many RNA viruses (Karlin et al., *J. Virol.* 68:2889-2897, 1994). Such dinucleotide pairs can fall across codon boundaries, or be contained within the codon.

Reducing Replicative Fitness

The replicative fitness of a pathogen is the overall replicative capacity of the pathogen to produce mature infectious progeny. By introducing one or more deoptimized codons into a coding region of a pathogen's gene(s), the replicative fitness of the pathogen decreases. In some examples, replicative fitness is decreased by at least 10%, at least 20%, at least 30%, at least 50%, at least 75%, at least 90%, at least 95%, or even at least 98%, as compared to an amount of replicative fitness by the a pathogen of the same species and strain in the absence of deoptimized codons. The disclosed methods can be used for making vaccines because the replicative fitness of the pathogen can be modulated by introducing different numbers of nucleotide changes. This flexibility can allow one to alter systematically the replicative fitness of a candidate vaccine strain in order to allow sufficient replication to induce an immune response, but not enough replication to cause pathogenicity.

Methods that can be used to measure the replicative fitness of a pathogen are known in the art and disclosed herein. For example, to measure the replicative fitness of a virus, plaque size can be measured, infectious center assays can be used, viral titer by TCID50 (tissue-culture infectious doses 50%) or plaque assays can be used, replication in single-step growth curves can be determined, temperature-sensitivity or cold-sensitivity of plaques determined, determination of whether the virus has an unusual host range, or competition assays with a related virus can be determined. To determine the replicative fitness of a bacterium or fungus, exemplary replicative fitness assays include assays for colony-forming activity, temperature-sensitivity, cold-sensitivity, slow growth under certain conditions, increased or rapid bacterial or fungal death, reduced ability of the bacteria or fungi to survive various stress conditions (such as nutrient deprivation), altered host range, enzymatic assays indicating reduced activity of a key enzyme, or assays for reduced pathogenicity due to decreased expression of an important protein (such as LPS). To measure the replicative fitness of a protozoan, exemplary replicative fitness assays include competitive growth assays with unmodified homologues, temperature-sensitivity, cold-sensitivity, slow growth under certain conditions, increased or rapid senescence, reduced ability to survive various stress conditions, altered host range, enzymatic assays indicating reduced activity of a key enzyme, or assays for reduced pathogenicity due to decreased expression of an important protein (such as surface antigens).

This disclosure provides several specific examples of pathogens containing deoptimized codons in various genes, including housekeeping genes and genes encoding proteins that are determinants of immunity. However, one skilled in the art will understand how to use the disclosed methods to deoptimize one or more codons in any pathogen of interest using publicly available codon usage tables and publicly available pathogen sequences In particular examples, a pathogen includes one or more deoptimized codons, for example at least 2, at least 3, at least 4, at least 5, at least 6, at least 7, at least 8, at least 9, at least 10, at least 20, at least 50, at least 100, at least 200, at least 300, at least 400, at least 500, at least 1000, or even at least 2000 deoptimized codons.

In some examples, a pathogen includes deoptimization of at least 5% of the codons in a gene that encode a particular amino acid, such as deoptimization of at least 5% of the codons that encode Ala (or another amino acid such as Leu, Thr, etc.), for example at least 10% of the codons that encode Ala (or another amino acid), at least 20% of the codons that encode Ala (or another amino acid), at least 50% of the codons that encode Ala (or another amino acid), or at least 90% of the codons that encode Ala (or another amino acid) in a gene. In particular examples, a pathogen includes deoptimization of at least 5% of the codons in one or more coding sequences, such as deoptimization of at least 10%, at least 20%, at least 30%, at least 40%, at least 50%, at least 60%, at least 70%, at least 80%, or even at least 90% of the codons in one or more coding sequences.

In one example, viral pathogen sequences are deoptimized in one or more nucleic acid sequences that encode proteins encoding surface antigens which are determinants of immunity, such as a capsid sequences, or spike glycoproteins.

In particular examples, deoptimizing the codon composition results in an altered G+C content of a coding sequence. For example, deoptimizing one or more codons can increase or decrease the G+C content by at least 10%, such as increase the G+C content of a coding sequence by at least 10%, such as at least 20%, at least 30%, at least 40%, at least 50%, at least 60%, at least 70%, at least 80%, or even by at least 90%, or decrease the G+C content of a coding sequence by at least 10%, such as at least 20%, at least 30%, at least 40%, at least 50%, at least 60%, at least 70%, at least 80%, or even by at least 90%. Whether the G+C content is increased or decreased will depend on the sequence of the pathogen of interest.

However, the G+C content can be deliberately altered in combination with deoptimizing one or more codons in a pathogen sequence. For example, some of the nucleotide substitutions can be made to deoptimize codons, and other nucleotide substitutions can be made to alter the G+C content of the sequence. Altering the G+C content of the sequence may also result in a deoptimized codon, but is not required in all instances.

In one example, the pathogen is a rubella virus, whose RNA genome has a high G+C content. Therefore, deoptimization of rubella can be achieved by decreasing the G+C content of one or more coding sequences of rubella, for example decreasing the G+C content by at least 10%, such as at least 20%, or even by at least 50%. In another example, the pathogen is a poliovirus or other eukaryotic virus, and deoptimization can be achieved by increasing the G+C content of one or more coding sequences, for example increasing the G+C content by at least 10%, such as at least 20%, or even by at least 50%. Such changes in G+C content can be achieved as a result of deoptimizing one or more codons, or in addition to deoptimizing one or more codons.

In some examples, deoptimizing the codon composition results in an altered frequency (number) of CG dinucleotides, TA dinucleotides, or both, in a coding sequence. For example, deoptimization of one or more codons may increase or decrease the frequency of CG or TA dinucleotides in the sequence by at least 10%, for example increase the number of CG or TA dinucleotides in a coding sequence by at least 10%, such as at least 20%, at least 30%, at least 40%, at least 50%, at least 60%, at least 100%, at least 200%, or even by at least 300%, or decrease in the number of CG or TA dinucleotides in a coding sequence by at least 10%, such as at least 20%, at least 30%, at least 40%, at least 50%, at least 60%, at least 70%, at least 80%, or even by at least 90%. Whether the number of CG or TA dinucleotides is increased or decreased will depend on the sequence of the pathogen of interest.

However, the number of CG or TA dinucleotides can be deliberately altered in combination with deoptimizing one or more codons in a pathogen sequence. For example, some of the nucleotide substitutions can be made to deoptimize codons, and other nucleotide substitutions can be made to alter the number of CG or TA dinucleotides in the coding sequence. Altering the number of CG or TA dinucleotides in the sequence may also result in a deoptimized codon, but is not required in all instances.

In one example, the pathogen is a poliovirus or eukaryotic virus, and deoptimization can be achieved by increasing the number of CG or TA dinucleotides in one or more coding sequences, for example increasing the number of CG or TA dinucleotides by at least 10%, such as at least 30%, or even by at least 300%. In another example, the pathogen is a bacterium, and deoptimization can be achieved by decreasing the number of CG or TA dinucleotides in one or more coding sequences, for example decreasing the number of CG or TA dinucleotides by at least 10%, such as at least 30%, or even by at least 50%.

In a particular example, the pathogen is a bacterium. Several methods can be used to deoptimize one or more codons in bacterial coding sequences. For example, one or more codons can be deoptimized such that a single rare codon (such as AGG) is used to force exclusive AGG usage in the mRNA encoding the arginyl tRNA synthetase, potentially limiting the pools of charged arginyl-tRNAs in the cell, and therefore synergistically further limiting the production of arginyl tRNA synthetase. In another example, one or more codons are deoptimized (for example by exclusively using AGG to encode for Arg residues) in one or more of the most highly expressed essential genes (such as translation factors). In yet another example, the distribution of codon-deoptimized genes along the genome is chosen to reduce the likelihood that all deoptimized genes could be exchanged out by any single natural recombination event.

Exemplary Pathogens

Any pathogen can be attenuated by deoptimizing one or more codons in one or more coding sequences. Exemplary pathogens include, but are not limited to, viruses, bacteria, fungi, and protozoa. For example, viruses include positive-strand RNA viruses and negative-strand RNA viruses. Exemplary positive-strand RNA viruses include, but are not limited to: Picornaviruses (such as Aphthoviridae [for example foot-and-mouth-disease virus (FMDV)]), Cardioviridae; Enteroviridae (such as Coxsackie viruses, Echoviruses, Enteroviruses, and Polioviruses); Rhinoviridae (Rhinoviruses)); Hepataviridae (Hepatitis A viruses); Togaviruses (examples of which include rubella; alphaviruses (such as Western equine encephalitis virus, Eastern equine encephalitis virus, and Venezuelan equine encephalitis virus)); Flaviviruses (examples of which include Dengue virus, West Nile virus, and Japanese encephalitis virus); and Coronaviruses (examples of which include SARS coronaviruses, such as the Urbani strain). Exemplary negative-strand RNA viruses include, but are not limited to: Orthomyxoviruses (such as the influenza virus), Rhabdoviruses (such as Rabies virus), and Paramyxoviruses (examples of which include measles virus, respiratory syncytial virus, and parainfluenza viruses).

Polioviruses are small (28 nm diameter), non-enveloped viruses whose single-stranded genome is enclosed in a capsid of 60 identical subunits arranged in icosahedral symmetry. Their positive-stranded genomes (~7500 nt) can serve directly as a messenger RNA, which is translated as a large (~250 kD) polyprotein from a single ORF. The polyprotein is post-translationally processed in a proteolytic cascade catalyzed by virus-encoded proteases, producing at least 10 distinct final cleavage products. Polioviruses grow rapidly in a wide variety of cultured human and simian cells, yielding $10^3$ to $10^4$ infectious particles per infected cell in ~8 hours. As with other RNA viruses, the poliovirus replicase lacks proofreading activity and consequently has a very high rate of base misincorporation (~$10^{-4}$ base substitution per base pair per replication; see Domingo et al. 2002. Error frequencies of picornavirus RNA polymerases: evolutionary implications for virus populations, p. 285-298. In B. L. Semler and E. Wimmer (ed.), Molecular Biology of Picornaviruses. ASM Press, Washington, D.C.; Drake and Holland, *Proc. Natl. Acad. Sci. USA* 96:13910-13, 1999). Polioviruses exist as three stable serotypes, and for each serotype strains with reduced replicative fitness (the "attenuated" Sabin oral poliovirus vaccine [OPV] strains) have been used throughout the world as live virus vaccines; see Sutter et al., 2003. Poliovirus vaccine—live, p. 651-705. In S. A. Plotkin and W. A. Orenstein (ed.), Vaccines, Fourth ed. W.B. Saunders Company, Philadelphia).

Viruses also include DNA viruses. DNA viruses include, but are not limited to: Herpesviruses (such as Varicella-zoster virus, for example the Oka strain; cytomegalovirus; and Herpes simplex virus (HSV) types 1 and 2), Adenoviruses (such as Adenovirus type 1 and Adenovirus type 41), Poxviruses (such as Vaccinia virus), and Parvoviruses (such as Parvovirus B19).

Another group of viruses includes Retroviruses. Examples of retroviruses include, but are not limited to: human immunodeficiency virus type 1 (HIV-1), such as subtype C, HIV-2; equine infectious anemia virus; feline immunodeficiency virus (FIV); feline leukemia viruses (FeLV); simian immunodeficiency virus (SIV); and avian sarcoma virus.

Another type of pathogen are bacteria. Bacteria can be classified as gram-negative or gram-positive. Exemplary gram-negative bacteria include, but are not limited to: *Escherichia coli* (K-12 and O157:H7), *Shigella dysenteriae*, and *Vibrio cholerae*. Exemplary gram-positive bacteria include, but are not limited to: *Bacillus anthracis, Staphylococcus aureus*, pneumococcus, gonococcus, and streptococcal meningitis.

Protozoa, nematodes, and fungi are also types of pathogens. Exemplary protozoa include, but are not limited to, *Plasmodium, Leishmania, Acanthamoeba, Giardia, Entamoeba, Cryptosporidium, Isospora, Balantidium, Trichomonas, Trypanosoma, Naegleria*, and *Toxoplasma*. Exemplary fungi include, but are not limited to, *Coccidiodes immitis* and *Blastomyces dermatitidis*. There is a great need for effective vaccines against protozoan pathogens. No effective vaccines for fungal pathogens have yet been identified.

Exemplary Genes which can be Deoptimized

The gene(s) (for example its corresponding coding sequence) chosen for codon deoptimization can vary depending on the pathogen of interest. In one example, one of the coding sequences deoptimized is a single copy gene that is important for survival of the pathogen, such as a "housekeeping" gene. In some examples, one of the coding sequences deoptimized is a determinant of immunity, such as a viral capsid coding sequence.

In one example, the virus is a positive strand virus, such as a picornavirus, for example a poliovirus, (for example the Sabin type 2 OPV strain or the MEF1 reference strain used in the inactivated poliovirus vaccine [IPV]) or foot-and-mouth-disease virus (FMDV) (such as serotype O), having one or more codons deoptimized in the capsid region of the virus. In one example, one or more of the Arg codons (such as all of the Arg codons in a reading frame) are replaced with a rare Arg codon, such as CGG. Such CGG-deoptimized picornaviruses can be used to produce inactivated poliovirus vaccine (IPV) in Vero cells expressing elevated levels of the corresponding rare tRNA. Such CGG-deoptimized IPV seed strains are less likely to infect workers in IPV production facilities, enhancing poliovirus containment after global polio eradication.

In one example, the positive strand virus is a togavirus, such as a rubella virus or alphavirus. In a particular example, the complete genome of such a virus is de-optimized. However, particular coding sequences can be de-optimized, such as envelope (E) protein E1, E2 or core protein.

In a specific example, the positive strand virus is a flavivirus, such as a dengue virus, West Nile virus, or Japanese encephalitis virus, and one or more codons in the coding sequence of a surface glycoprotein gene deoptimized (such as 8 different amino acid codons).

In a specific example, the positive strand virus is a coronavirus, such as the SARS coronaviruses (for example the Urbani strain). Such viruses can have one or more codons deoptimized in the coding sequence of a spike glycoprotein region (such as at least 5 different amino acid codons deoptimized).

In one example, the pathogen is an RNA virus, such as a negative-strand RNA virus. In a specific example, the virus is an orthomyxovirus, such as an influenza virus (such as strain H3N2), having one or more codons deoptimized in a hemagglutinin (HA) or neuraminidase (NA) coding sequence. In one example, the virus is a paramyxovirus, such as a measles virus having one or more codons deoptimized in a fusion (F) or hemagglutinin (H) coding sequence, or a respiratory syncytial virus having one or more codons deoptimized in a fusion (F) or glycoprotein (G) coding sequence.

In one example, the pathogen is a retrovirus, such as HIV-1 or HIV-2, and one or more codons are deoptimized in an envelope (env) or group antigen (gag) coding sequence.

In one example, the pathogen is a DNA virus, such as herpesviruses. In a specific example, the virus is a varicella zoster virus (such as the Oka strain), and one or more codons are deoptimized in a glycoprotein E or H coding sequence. In another specific example, the virus is a cytomegalovirus, and one or more codons are deoptimized in a glycoprotein B, H, or N coding sequence. In yet another specific example, the virus is herpes simplex virus types 1 or 2, and one or more codons are deoptimized in genes encoding surface glycoprotein B, glycoprotein D, integument protein, or the large subunit of ribonucleotide reductase.

In one example, the pathogen is a bacterium, such as gram-positive or gram-negative bacteria. In one gram-negative example, the bacterium is *Escherichia coli* (such as strains K-12 or O157:H7), and one or more Arg codons (such as all Arg codons) are replaced with the rare codon AGG in the ArgS gene (arginyl synthetase gene) and the highly expressed TufA gene (translation factor U). In another example, the bacterium is a *Shigella dysenteriae*, and one or more Arg codons (such as all Arg codons) are replaced with AGG in the RdsB gene. In one gram-positive example, the bacterium is *Staphylococcus aureus*, and one or more Arg codons (such as all Arg codons) are replaced with AGG in the RplB and FusA genes.

Pathogens with Deoptimized Codon Sequences as Immunogenic Compositions

The disclosed attenuated pathogens having a nucleic acid coding sequence with one or more deoptimized codons can be used in an immunogenic composition. In some examples, the deoptimized pathogens are further attenuated, for example by passage at suboptimal growth temperatures. Such immunogenic compositions can be used to produce an immune response against the pathogen in a subject, for example to treat a subject infected with the pathogen, decrease or inhibit infection by the pathogen, or reduce the incidence of the development of clinical disease.

In forming a composition for generating an immune response in a subject, or for vaccinating a subject, a purified, diluted, or concentrated pathogen can be utilized.

Compositions Including a Deoptimized Pathogen

In one example, purified or concentrated (or diluted) deoptimized pathogens that have one or more codons deoptimized are provided. In some examples, the immunogenic compositions are composed of non-toxic components, suitable for infants, children of all ages, and adults. Also disclosed are methods for the preparation of a vaccine, which include admixing a deoptimized pathogen of the disclosure and a pharmaceutically acceptable carrier. Although particular examples of deoptimized sequences are provided herein, one skilled in the art will appreciate that further modifications to the nucleic acid or protein sequence of the pathogen can be made without substantially altering the reduced replicative fitness due to the deoptimized codons. Examples of such further modifications include one or more deletions, substitutions, insertions, or combinations thereof, in the nucleic acid or protein sequence. In one example, such further modifications to a deoptimized pathogenic sequence do not increase the replicative fitness of the deoptimized pathogenic sequence by more than 5%, such as no more than 10%, as compared to an amount of replicative fitness by the deoptimized pathogen.

In one example, deoptimized pathogen sequences that include additional amino acid deletions, amino acid replacements, isostereomer (a modified amino acid that bears close structural and spatial similarity to the original amino acid) substitutions, isostereomer additions, and amino acid additions can be utilized, so long as the modified sequences do not increase the replicative fitness of the deoptimized pathogenic sequence by more than 5%, and retain the ability to stimulate an immune response against the pathogen. In another example, deoptimized pathogen sequences that include nucleic acid deletions, nucleic acid replacements, and nucleic acid additions can be utilized, so long as the modified sequences do not increase the replicative fitness of the deoptimized pathogenic sequence by more than 5%, and retains the ability to stimulate an immune response against the pathogen.

In one example, the deoptimized pathogenic nucleic acid sequences are recombinant.

The deoptimized pathogens can be replicated by methods known in the art. For example, pathogens can be transferred into a suitable host cell, thereby allowing the pathogen to replicate. The cell can be prokaryotic or eukaryotic.

The disclosed deoptimized pathogens can be used as immunogenic compositions, such as a vaccine. In one example, an immunogenic composition includes an immunogenically effective amount (or therapeutic amount) of an attenuated deoptimized pathogen of the disclosure, such as a viral, bacterial, fungal, or protozoan deoptimized pathogen. Immunogenically effective refers to the amount of attenuated deoptimized pathogen (live or inactive) administered at vaccination sufficient to induce in the host an effective immune response against virulent forms of the pathogen. An effective amount can being readily determined by one skilled in the art, for example using routine trials establishing dose response curves. In one example, the deoptimized pathogen can range from about 1% to about 95% (w/w) of the composition, such as at least 10%, at least 50%, at least 75%, or at least 90% of the composition.

Pharmaceutical compositions that include a deoptimized pathogen can also include other agents, such as one or more pharmaceutically acceptable carriers or other therapeutic ingredients (for example, antibiotics). In one example, a composition including an immunogenically effective amount of attenuated deoptimized pathogen also includes a pharmaceutically acceptable carrier. Particular examples of pharmaceutically acceptable carriers include, but are not limited to, water, culture fluid in which the pathogen was cultured, physiological saline, proteins such as albumin or casein, and protein containing agents such as serum. Other agents that can be included in the disclosed pharmaceutical compositions, such as vaccines, include, but are not limited to, pH control agents (such as arginine, sodium hydroxide, glycine, hydrochloric acid, citric acid, and the like), local anesthetics (for example, benzyl alcohol), isotonizing agents (for example, sodium chloride, mannitol, sorbitol), adsorption inhibitors (for example, Tween 80), solubility enhancing agents (for example, cyclodextrins and derivatives thereof), stabilizers (for example, serum albumin, magnesium chloride, and carbohydrates such as sorbitol, mannitol, starch, sucrose, glucose, and dextran), emulsifiers, preservatives, (such as chlorobutanol and benzalkonium chloride), wetting agents, and reducing agents (for example, glutathione).

When the immunogenic composition is a liquid, the tonicity of the formulation, as measured with reference to the tonicity of 0.9% (w/v) physiological saline solution taken as unity, can be adjusted to a value at which no substantial, irreversible tissue damage will be induced at the site of administration. Generally, the tonicity of the solution is adjusted to a value of about 0.3 to about 3.0, such as about 0.5 to about 2.0, or about 0.8 to about 1.7.

DNA Immunogenic Compositions

In one example, an immunogenic composition includes a deoptimized nucleic acid coding sequence instead of (or in addition to) the entire deoptimized pathogen. In particular examples, the sequence includes a sequence having at least 90%, at least 95%, or 100% sequence identity to any of SEQ ID NOS: 5, 8, 11, 14, 18, 21, 24, 27, 30, 33, 36, 39, 42, 45, 48, 51, 54, 55, 56, 57, 58, 67, 68, or 69. In some examples, an immunogenic composition includes a full-length deoptimized genome, for example a deoptimized poliovirus genome. However, one skilled in the art will appreciate that fragments of the deoptimized full-length genome can also be used (and in some examples ligated together). The DNA including the deoptimized coding sequence can be part of a vector, such as a plasmid, which is administered to the subject. Such DNA immunogenic compositions can be used to stimulate an immune response using the methods disclosed herein.

In one example, a deoptimized nucleic acid coding sequence from a pathogen is present in a colloidal dispersion system. Colloidal dispersion systems include macromolecule complexes, nanocapsules, microspheres, beads, and lipid-based systems including oil-in-water emulsions, micelles, mixed micelles, and liposomes. Large uni-lamellar vesicles (LUV), which range in size from 0.2-4.0 m can encapsulate a substantial percentage of an aqueous buffer containing large macromolecules. RNA, DNA and intact virions can be encapsulated within the aqueous interior and be delivered to cells in a biologically active form (Fraley et al., *Trends Biochem. Sci.* 6:77, 1981).

The composition of a liposome is usually a combination of phospholipids, particularly high-phase-transition-temperature phospholipids, usually in combination with steroids, such as cholesterol. Examples of lipids useful in liposome production include phosphatidyl compounds, such as phosphatidylglycerol, phosphatidylcholine, phosphatidylserine, phosphatidylethanolamine, sphingolipids, cerebrosides, and gangliosides. Particularly useful are diacylphosphatidyl-glycerols, where the lipid moiety contains from 14-18 carbon atoms, such as 16-18 carbon atoms, and is saturated. Illustrative phospholipids include egg phosphatidylcholine, dipalmitoylphosphatidylcholine and distearoylphosphatidylcholine.

Inducing an Immune Response

Methods are disclosed for stimulating an immune response in a subject using the disclosed deoptimized pathogens (such as a pathogen that includes a sequence having at least 90%, at least 95% or 100% sequence identity to any of SEQ ID NOS: 5, 8, 11, 14, 18, 21, 24, 27, 30, 33, 36, 39, 42, 45, 48, 51, 54, 55, 56, 57, 58, 67, 68, or 69) and immunogenic compositions. The method includes administering to a subject an immunologically effective amount of a deoptimized pathogen having a nucleic acid coding sequence with one or more deoptimized codons, which reduce the replicative fitness of the pathogen (for example by at least 20%, at least 50%, or even at least 99%). Such administration can be broadly effective for treatment and prevention of disease caused by a pathogen, and one or more associated symptoms thereof. In one example, the immunogenic compositions and methods are designed to confer specific immunity against infection with a pathogen, and to induce antibodies specific to the pathogen. The deoptimized pathogens can be delivered to a subject in a manner consistent with conventional methodologies associated with management of the disorder for which treatment or prevention is sought.

In selected examples, one or more symptoms or associated effects of exposure to or infection with a pathogen is prevented or treated by administration to a subject at risk of being infected by the pathogen, or presenting with one or more symptoms associated with infection by the pathogen, of an effective amount of a deoptimized pathogen of the disclosure. Therapeutic compositions and methods of the disclosure for prevention or treatment of toxic or lethal effects of pathogen infection are applicable to a wide spectrum of infectious agents.

Administration of Deoptimized Pathogens

For administration to animals or humans, the immunogenic compositions of the present disclosure, including vaccines, can be given by any method determined appropriate by a clinician. In addition, the immunogenic compositions disclosed herein can be administered locally or systemically. Types of administration include, but are not limited to, intramuscular, subcutaneous, oral, intravenous, intra-atrial, intra-articular, intraperitoneal, parenteral, intraocular, and by a variety of mucosal administration modes, including by oral, rectal, intranasal, intrapulmonary, or transdermal delivery, or by topical delivery to other surfaces.

The disclosed methods include administering a therapeutically effective amount of an attenuated pathogen having one or more deoptimized codon sequences (a deoptimized pathogen) to generate an immune response against the pathogen. Specific, non-limiting examples of an immune response are a B cell or a T cell response. Upon administration of the deoptimized pathogen, the immune system of the subject responds to the immunogenic composition (such as a vaccine) by producing antibodies, both secretory and serum, specific for one or more pathogen epitopes. Such a response signifies that an immunologically effective dose of the deoptimized pathogen was delivered. An immunologically effective dosage can be achieved by single or multiple administrations. In some examples, as a result of the vaccination, the subject becomes at least partially or completely immune to infection by the pathogen, resistant to developing moderate or severe pathogen infection, or protected from disease associated with infection by the pathogen. For example, an effective dose can be measured by detection of a protective antibody titer in the subject.

Typical subjects that can be treated with the compositions and methods of the present disclosure include humans, as well as veterinary subjects such as dogs, cats, horses, chickens, cows, fish, sheep, and pigs. To identify subjects for treatment according to the methods of the disclosure, accepted screening methods can be employed to determine risk factors associated with a targeted or suspected disease of condition (for example, polio) as discussed herein, or to determine the status of an existing disease or condition in a subject. These screening methods include, for example, conventional work-ups to determine environmental, familial, occupational, and other such risk factors that may be associated with the targeted or suspected disease or condition, as well as diagnostic methods, such as various ELISA and other immunoassay methods, which are available and well known in the art to detect or characterize disease-associated markers, such as antibodies present in the serum of a subject indicating that they were previously infected with a particular pathogen. The vaccines can also be administered as part of a routine health maintenance program in at risk individuals, such as the administration of meningococcal vaccines in children and pneumococcal or influenza vaccines in the elderly. These and other routine methods allow a clinician to select subjects in need of therapy using the methods and pharmaceutical compositions of the disclosure. In accordance with these methods and principles, a deoptimized pathogen can be administered using the methods disclosed herein as an independent prophylaxis or treatment program, or as a follow-up, adjunct or coordinate treatment regimen to other treatments, such as surgery, vaccination, or immunotherapy.

The compositions including deoptimized pathogens can be used for therapeutic purposes, such as prophylactically. When provided prophylactically, deoptimized pathogens are provided in advance of any symptom associated with the pathogen against which the prophylaxis is provided. The prophylactic administration of deoptimized pathogens serves to prevent or ameliorate any subsequent infection. When provided therapeutically, deoptimized pathogens are provided at (or shortly after) the onset of a symptom of disease or infection. The disclosed deoptimized pathogens can thus be provided prior to the anticipated exposure to a particular pathogen, so as to attenuate the anticipated severity, duration or extent of an infection or associated disease symptoms, after exposure or suspected exposure to the pathogen, or after the actual initiation of an infection.

The deoptimized pathogens disclosed herein can be administered to the subject in a single bolus delivery, via continuous delivery (for example, continuous transdermal, mucosal, or intravenous delivery) over an extended time period, or in a repeated administration protocol (for example, by an hourly, daily, weekly, or monthly repeated administration protocol). In one example, administration of a daily dose can be carried out both by single administration in the form of an individual dose unit or else several smaller dose units and also by multiple administrations of subdivided doses at specific intervals.

The therapeutically effective dosage of a deoptimized pathogen can be provided as repeated doses within a prolonged prophylaxis or treatment regimen that will yield clinically significant results to alleviate one or more symptoms or detectable conditions associated with a targeted disease or condition as set forth herein. Determination of effective dosages are typically based on animal model studies followed up by human clinical trials and is guided by administration protocols that significantly reduce the occurrence or severity of targeted disease symptoms or conditions in the subject. Various considerations are described, e.g., in Gilman et al., eds., *Goodman and Gilman: The Pharmacological Bases of Therapeutics*, 8th ed., Pergamon Press, 1990; and *Remington's Pharmaceutical Sciences*, 17$^{th}$ ed., Mack Publishing Co., Easton, Pa., 1990, each of which is herein incorporated by reference. Suitable models in this regard include, for example, murine, rat, porcine, feline, non-human primate, and other accepted animal model subjects known in the art.

Immunologically effective dosages can also be determined using in vitro models (for example, immunologic and histopathologic assays). Using such models, only ordinary calculations and adjustments are used to determine an appropriate concentration and dose to administer a therapeutically effective amount of the deoptimized pathogen (for example, amounts that are effective to elicit a desired immune response or alleviate one or more symptoms of a targeted disease). In some examples, amounts administered are those amounts adequate to achieve tissue concentrations at the site of action which have been found to achieve the desired effect in vitro. In alternative examples, an effective amount or effective dose of the deoptimized pathogens can decrease or enhance one or more selected biological activities correlated with a disease or condition.

For example, deoptimized pathogens of the present application can be tested using in vitro and in vivo models to confirm adequate attenuation, genetic stability, and immunogenicity for vaccine use. In a particular example, an in vitro assay is used to determine the attenuation and genetic stability of a deoptimized pathogen, for example using the plaque assays and virus yield, single-step growth assays described herein. In another example, deoptimized pathogens are further tested in animal models of infection, for example using the methods described herein. For example, a deoptimized pathogen can be administered to an animal model, and an amount of immunogenic response to the deoptimized pathogen determined, for example by analyzing antibody, T-cell or B-cell production. In some examples, the animal is further exposed to the pathogen, and resistance to infection determined.

The actual dosage of the deoptimized pathogen can vary according to factors such as the disease indication and particular status of the subject (for example, the subject's age, weight, fitness, extent of symptoms, susceptibility factors, and the like), time and route of administration, the type of pathogen against which vaccination is sought, other drugs or treatments being administered concurrently, as well as the specific pharmacology of the deoptimized pathogens for eliciting the desired activity or biological response in the subject. Dosage regimens can be adjusted to provide an optimum prophylactic or therapeutic response. A therapeutically effective amount is also one in which any toxic or detrimental side effects of a deoptimized pathogen are outweighed in clinical terms by therapeutically beneficial effects.

In one example, an immunogenic composition includes any dose of deoptimized bacteria sufficient to evoke an immune response, such as a range of between $10^3$ and $10^{10}$ bacteria per dose, for example at least $10^3$ bacteria, at least $10^4$ bacteria, at least $10^5$ bacteria, at least $10^8$ bacteria, or at least $10^9$ bacteria per dose. In one example, an immunogenic composition includes any dose of deoptimized virions sufficient to evoke an immune response, such as a range of between $10^3$ to $10^{10}$ plaque forming units (PFU) or more of virus per subject, such as $10^4$ to $10^5$ PFU virus per subject, for example at least $10^3$ PFU virus per subject, at least $10^4$ PFU virus per subject, at least $10^5$ PFU virus per subject, or at least $10^9$ PFU virus per subject. In another example, an immunogenic composition includes any dose of deoptimized protozoa sufficient to evoke an immune response, such as at least $10^2$ infectious units per subject, for example at least $10^3$ infectious units per subject, or a range of between $10^2$ to $10^6$ infectious units per subject. In any event, the immunogenic compositions ideally provide a quantity of deoptimized pathogen sufficient to effectively protect the subject against serious or life-threatening pathogen infection.

For each particular subject, specific dosage regimens can be evaluated and adjusted over time according to the individual need and professional judgment of the person administering or supervising the administration of the deoptimized pathogen. For example, in neonates and infants, multiple administrations can be required to elicit sufficient levels of immunity. In some examples, administration of the disclosed immunogenic compositions begins within the first month of life and continues at intervals throughout childhood, such as at two months, six months, one year and two years, as necessary to maintain sufficient levels of protection against pathogen infection. Similarly, adults who are particularly susceptible to repeated or serious infection by pathogens, such as health care workers, day care workers, elderly individuals, and individuals with compromised cardiopulmonary function, may require multiple immunizations to establish or maintain protective immune responses. Levels of induced immunity can be monitored by measuring amounts of neutralizing secretory and serum antibodies, and dosages adjusted or vaccinations repeated as necessary to maintain desired levels of protection.

The antibody response of a subject administered the compositions of the disclosure can be determined by using effective dosages/immunization protocols. In some examples, it is sufficient to assess the antibody titer in serum or plasma obtained from the subject. Decisions as to whether to administer booster inoculations or to change the amount of the immunogenic composition administered to the individual can be at least partially based on the antibody titer level. The antibody titer level can be based on, for example, an immunobinding assay which measures the concentration of antibodies in the serum which bind to a specific antigen present in the pathogen. The ability to neutralize in vitro and in vivo biological effects of the pathogen of interest can also be assessed to determine the effectiveness of the treatment.

Dosage can be varied by the attending clinician to maintain a desired concentration at a target site. Higher or lower concentrations can be selected based on the mode of delivery. Dosage can also be adjusted based on the release rate of the administered formulation. To achieve the same serum concentration level, for example, slow-release particles with a release rate of 5 nanomolar (under standard conditions) would be administered at about twice the dosage of particles with a release rate of 10 nanomolar.

Kits

The instant disclosure also includes kits, packages and multi-container units containing the herein described deoptimized pathogens, alone or in the presence of a pharmaceutically acceptable carrier, and in some examples, an adjuvant. Such kits can be used in the treatment of pathogenic diseases in subjects. In one example, these kits include a container or formulation that contains one or more of the deoptimized pathogens described herein. In one example, this component is formulated in a pharmaceutical preparation for delivery to a subject. The deoptimized pathogens can be contained in a bulk dispensing container or unit or multi-unit dosage form.

Optional dispensing means can be provided, for example a pulmonary or intranasal spray applicator, or a needle. Packaging materials optionally include a label or instruction indicating for what treatment purposes, or in what manner the pharmaceutical agent packaged therewith can be used.

The subject matter of the present disclosure is further illustrated by the following non-limiting Examples.

Example 1

Codon Usage in Poliovirus

This example describes methods used to determine codon usage in poliovirus.

Mononucleotide and dinucleotides frequencies, and codon usage were analyzed in the original reports of poliovirus genomic sequences (Kitamura et al. 1981. *Nature* 291:547-53; Racaniello and Baltimore. 1981. *Proc. Natl. Acad. Sci. USA* 78:4887-91; Rothberg and Wimmer. 1981. *Nucleic Acids Res.* 9:6221-9; Toyoda et al. 1984. *J. Mol. Biol.* 174:561-85). The mono-, di-, and trinucleotide frequency patterns are similar for the three Sabin strains (Toyoda et al. 1984. *J. Mol. Biol.* 174:561-85) and appear to be conserved across poliovirus genotypes (Hughes et al. 1986. *J. Gen. Virol.* 67:2093-102; Kew et al. 2002. *Science* 296:356-9; La Monica et al. 1986. *J. Virol.* 57:515-25; Liu et al. 2003. *J. Virol.* 77:10994-1005; Martin et al. 2000. *Virology* 278:42-9; Yang et al. 2003. *J. Virol.* 77:8366-77) and human enterovirus species C serotypes (Brown et al. 2003. *J. Virol.* 77:8973-84).

As with other enteroviruses, the component bases in the Sabin 2 ORF are present in approximately equal proportions (24.0% U, 22.9% C, 29.9% A, and 23.1% G; see Rezapkin et al., *Virology* 258:152-60, 1999; Toyoda et al., *J. Mol. Biol.* 174:561-85, 1984), thus permitting a low bias in codon usage (Osawa et al., *Microbiol. Rev.* 56:229-264, 1992). Indeed, all codons are used in poliovirus ORFs (Toyoda et al., *J. Mol. Biol.* 174:561-85, 1984), and the overall degree of codon usage bias is low (Jenkins and Holmes. *Virus Res.* 92:1-7, 2003).

One measure of codon usage bias is the number of effective codons ($N_C$), which can vary from 20 (only one codon used for each amino acid) to 61 (all codons used randomly) (Wright, *Gene* 87:23-9, 1990). The $N_C$ values for Sabin 2 are 56.0 for the capsid region and 54.6 for the complete ORF. As with the genomes of vertebrates and most RNA viruses, the dinucleotide CG is suppressed in the Sabin 2 genome (Toyoda et al., *J. Mol. Biol.* 174:561-85, 1984), and the observed pattern of codon usage reflects this CG suppression (Table 1).

TABLE 1

Codon usage in mutagenized capsid interval and complete ORF in unmodified and deoptimized Sabin 2 genomes.

| | | Codon usage (number) | | | | | |
|---|---|---|---|---|---|---|---|
| | | Capsid interval (nt 748 to 3303) Construct | | | Complete ORF (nt 748 to7368) Construct | | |
| Amino acid | Codon[a] | ABCD[b] | ABCd[c] | abcd[d] | ABCD | ABCd | abcd |
| Arg | CGA | 4 | 1 | 0 | 7 | 4 | 3 |
| | CGC | 11 | 7 | 0 | 13 | 9 | 2 |
| | CGG | 2 | 17 | 39 | 7 | 22 | 44 |
| | CGU | 0 | 0 | 0 | 3 | 3 | 3 |
| | AGA | 17 | 9 | 0 | 45 | 37 | 28 |
| | AGG | 5 | 5 | 0 | 23 | 23 | 18 |
| Leu | CUA | 7 | 6 | 1 | 33 | 32 | 27 |
| | CUC | 7 | 6 | 0 | 27 | 26 | 20 |
| | CUG | 14 | 10 | 0 | 25 | 21 | 11 |

TABLE 1-continued Codon usage in mutagenized capsid interval and complete
ORF in unmodified and deoptimized Sabin 2 genomes.

| Amino acid | Codon[a] | Codon usage (number) | | | | | |
|---|---|---|---|---|---|---|---|
| | | Capsid interval (nt 748 to 3303) Construct | | | Complete ORF (nt 748 to 7368) Construct | | |
| | | ABCD[b] | ABCd[c] | abcd[d] | ABCD | ABCd | abcd |
| | CUU | 4 | 14 | 55 | 22 | 32 | 73 |
| | UUA | 9 | 9 | 1 | 25 | 25 | 17 |
| | UUG | 18 | 14 | 2 | 40 | 36 | 24 |
| Ser | UCA | 18 | 11 | 0 | 43 | 36 | 25 |
| | UCC | 14 | 11 | 2 | 33 | 30 | 21 |
| | UCG | 6 | 1 | 0 | 8 | 3 | 2 |
| | UCU | 8 | 7 | 0 | 19 | 18 | 11 |
| | AGC | 9 | 25 | 63 | 20 | 36 | 74 |
| | AGU | 10 | 10 | 0 | 26 | 26 | 16 |
| Thr | ACA | 20 | 17 | 0 | 47 | 44 | 27 |
| | ACC | 24 | 19 | 1 | 55 | 50 | 32 |
| | ACG | 11 | 23 | 74 | 17 | 29 | 80 |
| | ACU | 20 | 16 | 0 | 47 | 43 | 27 |
| Pro | CCA | 21 | 16 | 0 | 53 | 48 | 32 |
| | CCC | 19 | 15 | 0 | 32 | 28 | 13 |
| | CCG | 9 | 21 | 59 | 19 | 31 | 69 |
| | CCU | 12 | 9 | 2 | 18 | 15 | 8 |
| Ala | GCA | 23 | 16 | 0 | 61 | 54 | 38 |
| | GCC | 16 | 13 | 2 | 40 | 37 | 26 |
| | GCG | 10 | 26 | 66 | 17 | 33 | 73 |
| | GCU | 19 | 13 | 0 | 49 | 43 | 30 |
| Gly | GGA | 12 | 8 | 0 | 38 | 34 | 26 |
| | GGC | 8 | 7 | 0 | 30 | 29 | 22 |
| | GGG | 20 | 16 | 2 | 37 | 33 | 19 |
| | GGU | 14 | 23 | 52 | 42 | 51 | 80 |
| Val | GUA | 10 | 8 | 1 | 24 | 22 | 15 |
| | GUC | 10 | 27 | 55 | 21 | 38 | 66 |
| | GUG | 20 | 10 | 1 | 55 | 45 | 36 |
| | GUU | 17 | 12 | 0 | 40 | 35 | 23 |
| Ile | AUA | 16 | 12 | 0 | 30 | 26 | 14 |
| | AUC | 15 | 22 | 45 | 47 | 54 | 77 |
| | AUU | 14 | 11 | 0 | 59 | 56 | 45 |
| Lys | AAA | 13 | 13 | 13 | 64 | 64 | 64 |
| | AAG | 18 | 18 | 18 | 58 | 58 | 58 |
| Asn | AAC | 25 | 25 | 25 | 61 | 61 | 61 |
| | AAU | 25 | 25 | 25 | 52 | 52 | 52 |
| Gln | CAA | 18 | 18 | 18 | 47 | 47 | 47 |
| | CAG | 9 | 9 | 9 | 32 | 32 | 32 |
| His | CAC | 12 | 12 | 12 | 30 | 30 | 30 |
| | CAT | 6 | 6 | 6 | 19 | 19 | 19 |
| Glu | GAA | 16 | 16 | 16 | 57 | 57 | 57 |
| | GAG | 19 | 19 | 19 | 56 | 56 | 56 |
| Asp | GAC | 23 | 23 | 23 | 51 | 51 | 51 |
| | GAU | 19 | 19 | 19 | 62 | 62 | 62 |
| Tyr | UAC | 21 | 21 | 21 | 57 | 57 | 57 |
| | UAU | 16 | 16 | 16 | 43 | 43 | 43 |
| Cys | UGC | 10 | 10 | 10 | 20 | 20 | 20 |
| | UGU | 5 | 5 | 5 | 22 | 22 | 22 |
| Phe | UUC | 14 | 14 | 14 | 36 | 36 | 36 |
| | UUU | 21 | 21 | 21 | 48 | 48 | 48 |
| Met | AUG | 26 | 26 | 26 | 67 | 67 | 67 |
| Trp | UGG | 13 | 13 | 13 | 28 | 28 | 28 |

[a]Unpreferred codons used as replacement codons are shown in boldface font.
[b]ABCD represents virus construct S2R9, which differs from the reference Sabin 2 strain sequence at three synonymous third-position sites: $A_{2616} \rightarrow G$ (VP1 region), $A_{3303} \rightarrow T$ (VP1 region), and $T_{5640} \rightarrow A$ ($3C^{pro}$ region).
[c]ABCd represents virus construct S2R19, which has replacement codons across an interval spanning 76% of the VP1 region.
[d]abcd represents virus construct S2R23, which has replacement codons across an interval spanning 97% of the capsid region.

Example 2

Poliovirus Containing a Deoptimized Capsid Region

This example describes methods used to generate a poliovirus containing deoptimized codons in the capsid region. Briefly, the original capsid region codons of the Sabin type 2 oral polio vaccine strain were replaced with synonymous codons less frequently used in poliovirus genomes. An unpreferred synonymous codon was used nearly exclusively to code for each of nine amino acids. Codon changes were introduced into four contiguous intervals spanning 97% of the capsid region.

The strategy for codon replacement was as follows. Despite the low overall bias in codon usage in Sabin 2, some synonymous codons are used at much lower frequencies than others (Table 1). To determine codon usage in Sabin 2, the preferred codons for each of nine amino acids were replaced with a synonymous unpreferred codon (Table 1). The codon replacements shown in Table 1 were introduced only within the capsid sequences, because those sequences uniquely identify a poliovirus serotype, as both noncapsid and 5'-UTR region sequences are exchanged out by recombination with other species C enteroviruses during poliovirus circulation.

Because codon usage bias was very low for most two-fold degenerate codons (except codons for His and Tyr), only six-fold, four-fold, and three-fold degenerate codons were replaced. Synonymous codons for nine amino acids were replaced by a single unpreferred codon: CUU for Leu, AGC for Ser, CGG for Arg, CCG for Pro, GUC for Val, ACG for Thr, GCG for Ala, GGU for Gly, and AUC for Ile (Table 1). Whenever possible, codons with G or C at degenerate positions (the nucleotides that differ within the codons that encode for a particular amino acid) were chosen to increase the G+C content of the modified viral genomes.

For example, as shown in Table 1, the amino acid Leu is encoded by 6 different codons in Sabin 2. However, the codon CUU is used the least frequently of the six. Therefore, it was selected to replace the other five codons. Similarly, the amino acid Pro is encoded by four different codons in Sabin 2. However, the codon CCG is used the least frequently of the four. Therefore, it was selected to replace the other three codons. A similar analysis was performed for the least frequently used codon for Thr and Ala. For the amino acid Ser, although the codon UCG was less frequently used than AGC in Sabin 2, AGC was chosen to deoptimize the sequence because it was the least preferred Ser codon among a larger collection of VP1 sequences of wild polioviruses. Similarly, GGU was the least preferred Gly codon among a larger collection of VP1 sequences of wild polioviruses. Codons CGG and AUC were selected for Arg and Ile, respectively, because they were not preferred and their usage would increase the G+C content of the poliovirus genome.

In addition, some codons did not display a significant amount of bias, and were therefore not selected. For example, the amino acid Asp is encoded in the Sabin 2 capsid region by 19 and 23 GAU and GAC codons, respectively. Similarly, the amino acid Glu is encoded in the Sabin 2 capsid region by 16 and 19 GAA and GAG codons, respectively. Since these values are similar, it is not likely that substitution of one for the other would reduce replicative fitness of the pathogen. Ideally, in the case where there are at least two codons that encode for an amino acid in the pathogen, there is at least a 20% difference between the selected codon and one or more of the other codons that encode the amino acid, such as an at least 30% difference, or an at least 50% difference.

Figure 2:
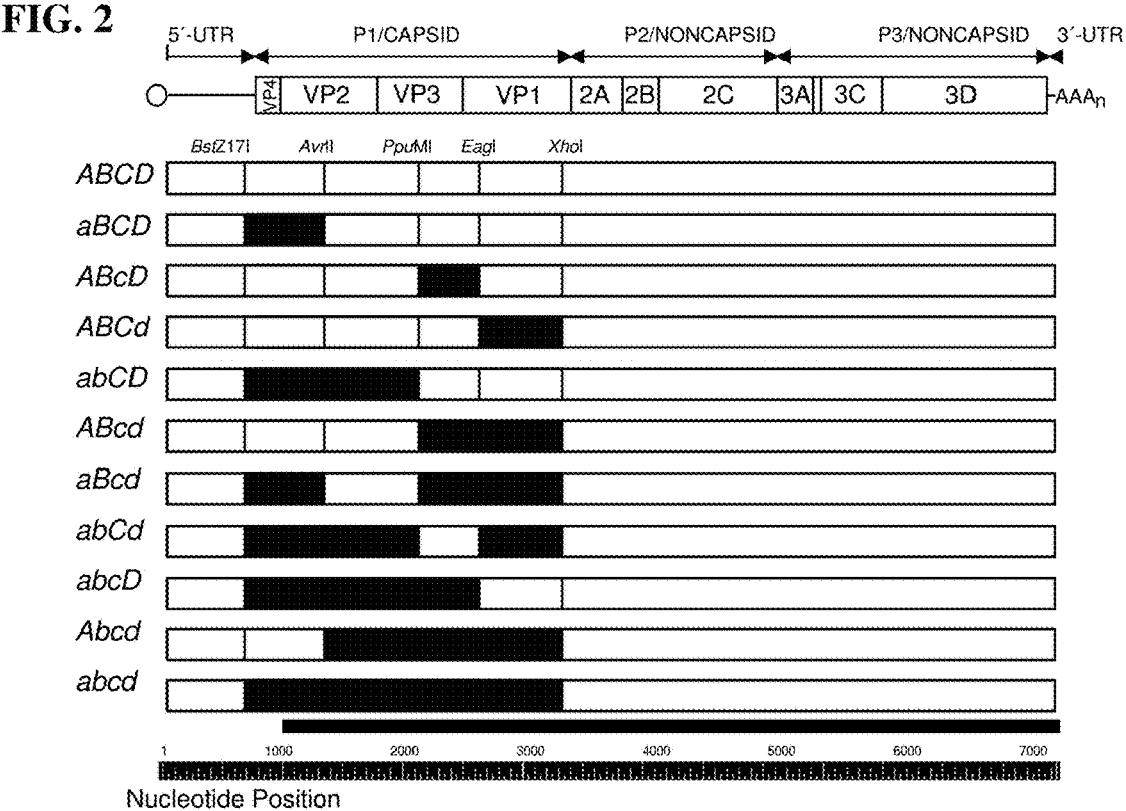
FIG. 2 is a schematic drawing showing exemplary Sabin 2 codon replacement constructs. The Sabin 2 genome is represented with open rectangles. Filled rectangles indicate the locations of individual cassettes, black-filled rectangles indicate cassettes with replacement codons. Unmodified cassettes are indicated by upper case letters; the corresponding cassettes with replacement codons are indicated by lower case letters.
Figure 1B:
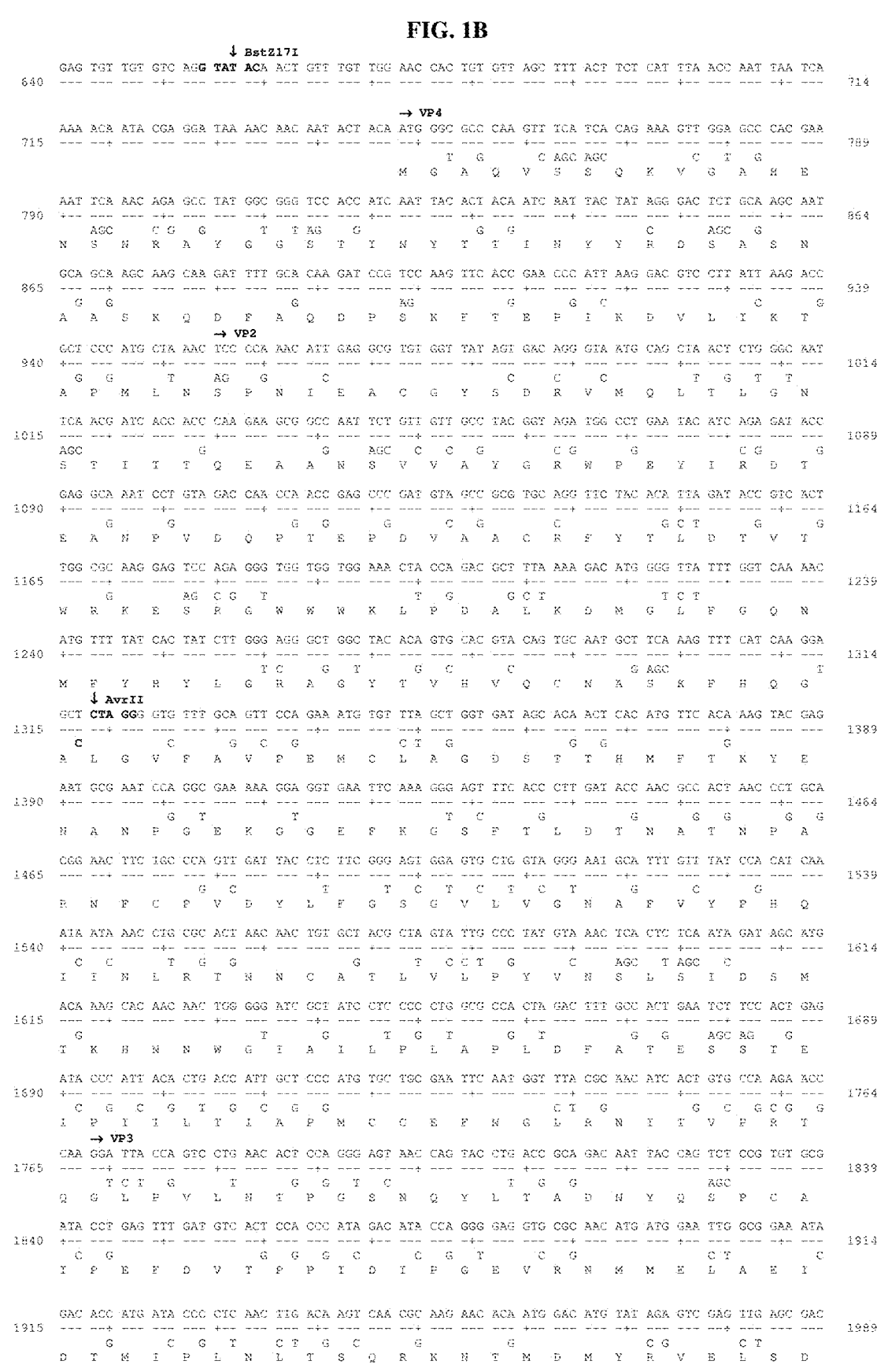
Figure 1C:
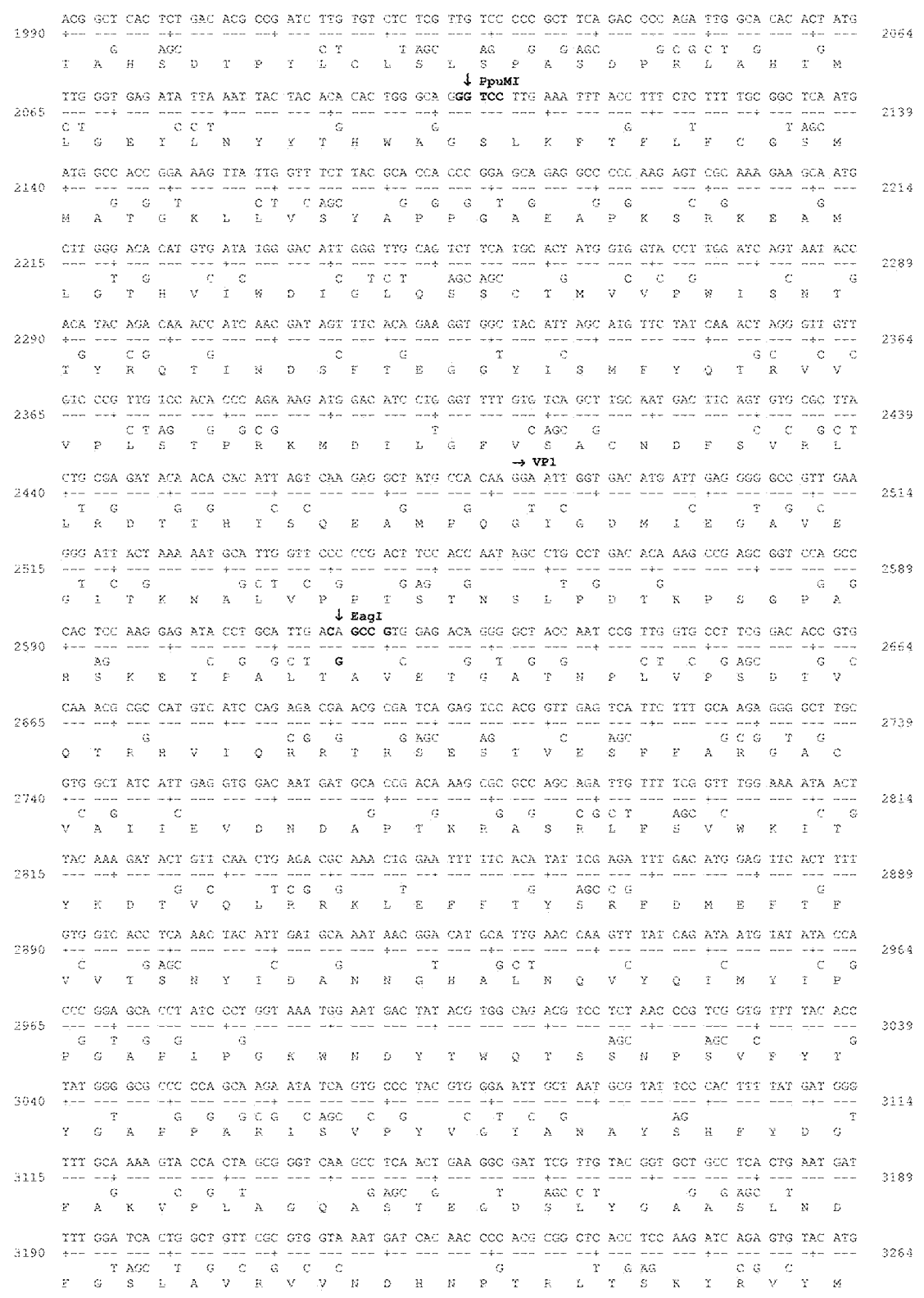

Replacement codons were introduced into a full-length infectious cDNA clone derived from Sabin 2 (construct S2R9) within an interval (nt 748 to 3302) spanning all but the last 27 codons of the capsid region (FIGS. 1A-D). The capsid interval was divided into four mutagenesis cassettes:

A (nt 657 to 1317; 661 bp), B (nt 1318 to 2102; 785 bp), C (nt 2103 to 2615; 513 bp), and D (nt 2616 to 3302; 687 bp) (FIG. 1A). Mutagenesis cassette A, bounded by restriction sites BstZ17I and AvrII, includes the last 91 nucleotides of the 5'-UTR, but no 5'-UTR sequences were modified in cassette A. Within each cassette, synonymous codons for the nine amino acids were comprehensively replaced except at 15 positions (replacement at 11 of these positions would have eliminated desirable restriction sites or generated undesirable restriction sites). Unmodified cassettes are identified by uppercase italic letters; the corresponding cassettes with replacement codons are identified by lowercase italic letters. Thus, as shown in FIG. 2, the reference Sabin 2 derivative (derived from cDNA construct S2R9) is identified as ABCD (SEQ ID NO: 3), and the fully modified virus (derived from cDNA construct S2R23) is identified as abcd (SEQ ID NO: 5).

The methods described below were used to generate the deoptimized polioviruses.

Virus and cells. The Sabin Original+2 (Sabin and Boulger. *J. Biol. Stand.* 1:115-8, 1973) master seed of the Sabin type 2 oral poliovaccine strain (P712 ch 2ab) was provided by R. Mauler of Behringwerke AG (Marburg, Germany). Virus was grown at 35° C. in suspension cultures as previously described (Rueckert and Pallansch. *Meth. Enzymol.* 78:315-25, 1981) of S3 HeLa cells (human cervical carcinoma cells; ATCC CCL-2.2) or in monolayer cultures of HeLa (ATCC CCL-2), and RD (human rhabdomyosarcoma cells; ATCC CCL-136) cells. Some initial plaque assays were performed in HEp-2C cells (Chen, *Cytogenet. Cell Genet.* 48:19-24, 1988).

Preparation of infectious Sabin 2 clones. Poliovirus RNA was extracted from 250 µl of cell culture lysate (from ~75,000 infected cells) by using TRIZOL LS reagent (Life Technologies, Rockville, Md.) and further purified on CENTRI-SEP columns (Princeton Separations, Adelphia, N.J.). Full-length cDNA was reversed transcribed (42° C. for 2 hours) from ~1 µg of viral RNA in a 20 µl reaction containing 500 µM dNTP (Roche Applied Science, Indianapolis, Ind.), 200 U Superscript II Reverse Transcriptase (Life Technologies), 40 U RNase-inhibitor (Roche), 10 mM dithiothreitol, and 500 ng primer S2-7439A-B [CCTAAGC(T)$_{30}$CCCCGAATTAAAGAAAAATT TACCCCTACA; SEQ ID NO: 1] in Superscript II buffer.

After reverse transcription, 2 U RNase H (Roche) was added and incubated at 37° C. for 40 min. Long PCR amplification of viral cDNA was performed using TaqPlus Precision (Stratagene, La Jolla, Calif.) and AmpliWax PCR Gem 100 beads (Applied Biosystems, Foster City, Calif.) for "hot start" PCR in thin-walled tubes. The bottom mix (50 µl) contained 200 µM each dNTP (Roche) and 250 ng each of primers S2-7439A-B and S2-1S-C (GTAGTCGACTAATACGACTCACTATAGGT-TAAAACAGCTCTGGGGTTG; SEQ ID NO: 2) in TaqPlus Precision buffer. A wax bead was added to each tube, and samples were heated at 75° C. for 4 minutes and cooled to room temperature. The top mix (50 µl) contained 2 µl of the cDNA and 10 U TaqPlus Precision in TaqPlus Precision buffer. The samples were incubated in a thermal cycler at 94° C. for 1 minute and then amplified by 30 PCR cycles (94° C. for 30 seconds, 60° C. for 30 seconds, and 72° C. for 8 minutes), followed by a final 94° C. for 1 minute and final extension of 72° C. for 20 minutes.

PCR products were purified using QIAquick PCR purification kit (Qiagen, Valencia, Calif.) and sequentially digested for 2 hours at 37° C. with Sal I and Hind III prior to gel purification. PCR products were ligated to pUC19 plasmids following standard methods (Sambrook and Russell. 2001. *Molecular Cloning: A Laboratory Manual*, 3rd ed. Cold Spring Harbor Laboratory Press, Cold Spring Harbor, N.Y.) and ligated plasmids were transformed into XL-10 Gold supercompetent *E. coli* cells (Stratagene). Colonies were screened for recombinant plasmids on X-gal indicator plates (Sambrook and Russell. 2001. *Molecular Cloning: A Laboratory Manual*, 3rd ed. Cold Spring Harbor Laboratory Press, Cold Spring Harbor, N.Y.) and 6 white colonies were transferred to 1.5 ml Luria-Bertani broth containing 50 µg/ml ampicillin (LB/amp) (Roche). Plasmids were purified using QIAprep Spin Miniprep columns and sequences of the inserts were determined by cycle sequencing using an automated DNA sequencer (Applied Biosystems, Foster City, Calif.) (Liu et al., *J. Virol.* 74:11153-61, 2000). The full-length viral insert was sequenced in both orientations using overlapping sense and antisense primers spaced ~500 nt apart. Selected clones were grown in 50 ml LB/amp, and recombinant plasmids were purified using the QIAfilter Plasmid Maxi kit.

Virus Preparation. Plasmids were linearized with Hind III and purified using QIAquick columns prior to RNA transcription from 1 µg of plasmid DNA using the Megascript T7 In Vitro Transcription kit (Ambion, Austin, Tex.). RNA yields were estimated using DNA Dipsticks (Invitrogen, Carlsbad, Calif.) and RNA chain length was analyzed by electrophoresis on 1% formaldehyde gels prior to transfection. RD cells were transfected with transcripts of viral RNA by using Tfx-20 (Promega, Madison, Wis.). Briefly, semi-confluent RD cells in 12-well cell culture plates were inoculated with 500 µl MEM (MEM incomplete) (Life Technologies) containing 0.1 µg viral RNA transcript and 0.45 µl Tfx-20 Reagent. Plates were incubated for 1 hour at 35° C. prior to addition of 1.5 ml MEM complete [MEM incomplete supplemented with 100 U penicillin and 100 µg streptomycin, 2 mM L-glutamine, 0.075% NaHCO$_3$, 10 µM HEPES (pH 7.5)] (Life Technologies) containing 3% fetal calf serum (FCS; HyClone, Logan, Utah). Negative controls were performed using RNA transcribed from pBluescriptII SK+ (Stratagene) containing a viral insert truncated at base 7200 by digestion with BamHI and transcribed in a reverse orientation from a T3 promoter.

Complete CPE was observed after incubation at 35° C. for 18-20 hours at which time 400 µl from the transfected wells were transferred to a confluent RD cell monolayer in 75 cm$^2$ flasks containing MEM complete. Complete CPE was observed in the second passage after 24 hours at 35° C., and virus was liberated from the infected cells by three freeze-thaw cycles and clarification by centrifugation for 15 minutes at 15,000×g. Control wells were passaged once and monitored for 72 hours post-transfection. The sequences of all virus stocks were verified by RT-PCR amplification of two large overlapping fragments and subsequent sequence analysis of the PCR product.

Site-Directed Mutagenesis. Single-base substitutions were introduced using the QuikChange Site-Directed Mutagenesis Kit (Stratagene). Briefly, two complementary primers containing the desired mutation were designed for PCR amplification of the plasmid containing the Sabin 2 insert. Amplification was performed using Pfu Turbo DNA polymerase on 5 ng of template DNA for 15 cycles at 95° C. for 30 s, 50° C. for 1 minute, and 68° C. for 23 minutes. PCR products were digested for 1 hour at 37° C. with 10 U of Dpn I prior to transformation in XL-1 Blue Supercompetent cells. Colonies were grown and screened by sequencing as described above.

Assembly PCR. Multiple base substitutions were introduced by assembly PCR using previously described methods (Stemmer et al., Gene 164:49-53, 1995). Briefly, primers were designed to span the region of interest with complementary 40-mers overlapping by 10 nt on each end. A first round of assembly (30 PCR cycles of 94° C. for 45 seconds, 52° C. for 45 seconds, and 72° C. for 45 seconds) was performed with a 20 μl reaction mixture containing Taq Plus Precision buffer, 10 U Taq Plus Precision, 5 pmoles of each primer, and 200 μM dNTP. A second round of assembly (25 PCR cycles of 94° C. for 45 seconds, 50° C. for 45 seconds, and 72° C. for 2 minutes) was performed using the outermost sense and antisense primers in a 100 μl reaction mixture in Taq Plus Precision buffer containing 2 μl of product from the first assembly round, 10 U Taq Plus Precision, 200 ng of each primer, and 400 μM dNTP. PCR products were column purified prior to digestion, ligation, and transformation into XL-10 gold supercompetent $E.\ coli$ cells. Clones were grown and screened by sequencing of insert as described.

Construction of recombinant clones. The sequence of the full-length Sabin 2 infectious clone, S2R9, differed from the published sequence of a reference Sabin 2 strain (Rezapkin et al., Virology 258:152-60, 1999) at three synonymous third-codon positions: $G_{2616}$ (in VP1 region; A replaced to introduce an EagI restriction site) $T_{3303}$ (in VP1 region; A replaced to introduce a XhoI site), $A_{5640}$ (in $3C^{pro}$ region). The S2R9 construct was used as the reference Sabin 2 strain. Recombinant clones having different combinations of blocks of replacement codons were constructed using standard methods (Kohara et al., J. Virol. 53:786-92, 1985).

As shown in Tables 1 and 2, the modifications introduced dramatically altered the mono-, di-, and trinucleotide (codon) frequencies in the capsid region. In the fully modified construct, abcd, nearly half (427/879; 48.6%) of the capsid region codons were replaced, and a total of 544 substitutions (90 first codon position, 44 second position, and 410 third position) were introduced into the 2555 mutagenized capsid region nucleotides. This strategy for codon deoptimization increased the number of CG dinucleotides in the poliovirus templates. CG was the least abundant dinucleotide (181 occurrences) in the unmodified ABCD construct and the most abundant dinucleotide (386 occurrences) in the highly modified abcd construct. Compared with ABCD, the $N_C$ values in the capsid region of abcd fell from 56.2 to 29.8, the number of CG dinucleotides rose from 97 to 302, and the % G+C increased from 48.4% to 56.4% (Table 2). These changes were nearly uniformly distributed over the mutagenized capsid region (Table 2).

TABLE 2

Effective number of codons used ($N_C$), number of CG dinucleotides, and G + C content in mutagenized capsid region sequences.

| Construct[a] | Length of codon-replacement interval (bp) | $N_C$[b] | | | No. of CG dinucleotides[c] | | | % G + C | | |
|---|---|---|---|---|---|---|---|---|---|---|
| | | Replacement interval orig/mod[d] | Complete capsid region[e] | Complete ORF | Replacement interval orig/mod | Complete capsid region | Complete ORF | Replacement interval orig/mod | Complete capsid region | Complete ORF |
| ABCD[f] | 2555[g] | 56.0/56.0 | 56.2 | 54.6 | 94/94 | 97 | 181 | 48.5/48.5 | 48.4 | 46.0 |
| aBCD | 570[g] | 57.3/30.8 | 56.1 | 56.4 | 20/63 | 140 | 224 | 48.1/56.0 | 50.1 | 46.7 |
| AbCD | 785 | 56.0/29.9 | 53.1 | 55.7 | 25/89 | 161 | 245 | 48.4/56.1 | 50.7 | 47.0 |
| ABcD | 513 | 57.7/28.2 | 56.3 | 56.0 | 13/59 | 143 | 227 | 48.3/57.0 | 50.1 | 46.7 |
| ABCd | 687 | 54.0/28.4 | 54.6 | 56.5 | 36/88 | 149 | 233 | 49.1/57.7 | 50.7 | 46.5 |
| abcd | 2555 | 56.0/29.3 | 29.8 | 47.3 | 94/299 | 302 | 386 | 48.5/56.7 | 56.4 | 49.2 |

[a]Constructs correspond to the following infectious cDNA plasmids, clones, and virus derivatives: ABCD, S2R9; aBCD, S2R28; AbCD, not constructed; ABcD, S2R20; ABCd, S2R19; abcd, S2R23; $N_C$, number of CG dinucleotides, and % G + C of all other constructs can be calculated from table.
[b]$N_C$: effective number of codons used (1); one replacement codon spanned the EagI restriction cleavage site and was counted as part of cassette D.
[c]One CG dinucleotide spanned the EagI restriction cleavage site and was counted as part of the cassette D.
[d]orig/mod: original construct/modified codon-replacement construct.
[e]Complete capsid region: nt 748 to 3384.
[f]The S2R9 (ABCD) sequence differs from the reference Sabin 2 sequence at three synonymous third-position sites (see Table 1).
[g]Does not include the 3'-terminal 91 bases of the 5'-UTR at the 5'-end of cassette A (nt 657 to 747) that were not modified.

Example 3

Growth Properties of Codon-Deoptimized Constructs

This example describes methods used to determine the growth properties of the deoptimized Sabin 2 polioviruses generated in Example 2. Similar methods can be used to determine the replicative fitness of any deoptimized virus.

Briefly, RNA transcripts of constructs with different combinations of codon-replacement cassettes (FIG. 2) were transfected into RD cells as described above. Virus obtained from the primary transfection was passaged again in RD cells to increase virus titers as described above. The growth properties of the virus constructs in HeLa cells were measured by plaque assays (FIGS. 3A-E) and single-step growth experiments (FIGS. 4A-B).

Plaque assays were performed by a modification of previously described methods (Yang et al. J. Virol. 77:8366-77, 2003). Briefly, confluent HeLa cell monolayers in 100 $cm^2$ cell culture dishes were washed, inoculated with virus in MEM incomplete, and incubated at room temperature for 30 minutes prior to the addition of 0.45% SeaKem LE Agarose (BioWhittaker Molecular, Rockland, Me.) in MEM complete containing 2% FCS. Plates were incubated for 52-60 hours at 35° C., fixed with 0.4% formaldehyde and stained with 3% crystal violet. Plaque size was quantified by scanning plates on a FOTO/Analyst Archiver system (Fotodyne, Hartland, Wis.) and subsequent image analysis using Scion Image for Windows (Scion Corp., Frederick, Md.).

Figure 3E:
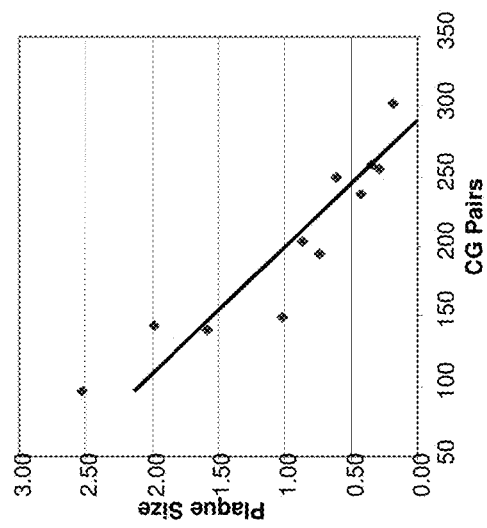
FIG. 3E is a graph showing the inverse linear relationship observed between plaque area and number of CG pairs in Sabin 2.
Figure 3D:
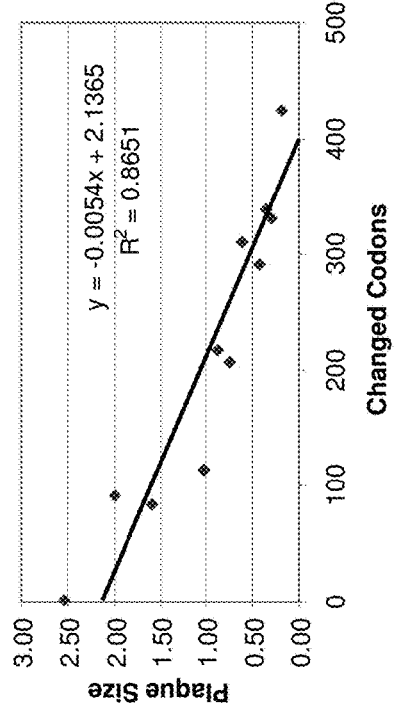
FIG. 3D is a graph showing the inverse linear relationship observed between plaque area and number of replacement codons in Sabin 2.
Figure 4B:
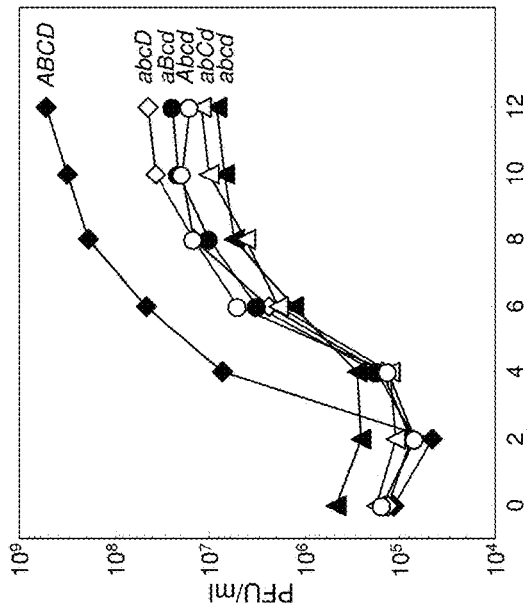
FIGS. 4A and 4B are graphs showing single-step growth curves in HeLa S3 cells at 35° C.
Figure 4A:
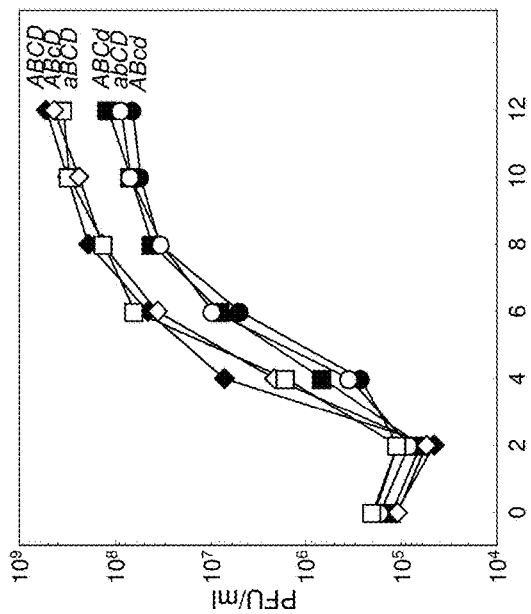

As shown in FIGS. 3A and 3C, an approximately linear inverse relationship was observed between mean plaque area in HeLa cells and the number of nucleotide changes in the capsid region. Similar inverse linear relationships were observed when the abscissa was rescaled to the number of replacement codons (FIG. 3D) or to the number of CG dinucleotides (FIG. 3E). There was no strong polarity to the effects of codon replacement within the capsid region, as introduction of replacement codons into any combination of the four cassettes reduced plaque areas approximately in proportion to the total number of replacement codons. However, replacement of codons into VP1 (cassette D) appeared to have slightly stronger effects than replacement elsewhere. Codon replacement in three or four cassettes generally conferred a minute-plaque phenotype (mean plaque area <25% that of the unmutagenized ABCD prototype), and the mean areas of the observed plaques of the abcd construct were ~9% of the ABCD prototype (FIG. 3C). An exception was the abcD construct, which had a greater mean plaque area (~38% that of the ABCD prototype) than the Abcd, aBcd, and abCd constructs, underscoring the stronger influence upon plaque size of codon replacement within VP1.

Measurement of plaque areas and total plaque number became difficult as plaque size decreased. The diameters of poliovirus plaques are typically heterogeneous, and this heterogeneity was observed with the plaques of all constructs. Precise measurement was most difficult with the smallest of the minute plaques, as was discriminating very minute plaques from other small defects in the cell monolayers. Extended incubation of plaque cultures to 72 hours increased plaque diameters but did not markedly increase the plaque counts. Growth properties of all constructs were also determined by plaque assays and limit dilution infectivity assays in HEp-2(C) cells at 35° C. For some of the constructs (abcd, abCD, AbcD, ABcd, and aBCd), the limit dilution infectivity titer was 2-10 fold higher than the plaque titers. For the other constructs, limit dilution infectivity and plaque titers were similar. The plaque titers might have been underestimated for some constructs because of the difficulty in seeing the tiniest plaques.

A plaque is the result of several cycles of replication, which effectively amplifies any difference in replication rate. To determine the relationship between plaque size, virus growth rates, and virus yield, single-step growth experiments (input MOI: 5 PFU/cell) were performed as follows. S3 HeLa suspension cells ($1 \times 10^7$) were infected at a multiplicity of infection (MOI) of 5 PFU/cell with stirring for 30 minutes at 25° C. After 30 minutes, cells were sedimented by low-speed centrifugation and resuspended in 2.5 ml warm complete media SMEM containing glutamine, 5% FCS, penicillin-streptomycin, and 25 mM HEPES (pH 7.5). Incubation continued at 35° C. in a water bath with orbital shaking at 300 rpm. Samples were withdrawn at 2-hour intervals from 0 to 14 hours postinfection, and titered by plaque assay in Hep-2(C) cells (35° C., 72 hours).

As shown in FIGS. 3B, 4A and 4B, mean virus yields from the single-step growth assays generally decreased as the number of replacement codons increased. Virus yields were highest (~200 PFU/cell) for the ABCD prototype and constructs ABcD and aBCD. Yields were 4- to 8-fold lower with constructs ABCd, abCD, and ABcd, 12- to 24-fold lower with constructs abcD and aBcd, 30- to 45-fold lower with constructs Abcd and abCd, and ~65-fold lower with construct abcd. Moreover, production of infectious virus appeared to be slower in the codon-replacement constructs than in the unmodified ABCD construct. Although maximum plaque yields were obtained at 10-12 hours for all constructs, proportion of the final yields detected at 4 hours were lower for the codon-deoptimized constructs (FIGS. 4A and 4B).

In summary, although the Sabin 2 OPV strain has a relatively low codon usage bias, its replicative fitness in cell culture was reduced by replacement of preferred codons in the capsid region with synonymous unpreferred codons. The reduction in fitness, as measured by plaque area, was approximately proportional to the length of the interval containing replacement codons. Plaque areas were reduced by ~90% and virus burst yields by ~98% in the abcd construct, in which the replacement interval spanned nearly the entire capsid region. The fitness declines in the replacement codon constructs are not attributable to amino acid substitutions because all constructs encoded the same reference Sabin 2 polyprotein sequence. Virus yields varied over a ~65-fold range in response to the extent of codon deoptimization.

Multiple synonymous capsid codon replacements increase the ability to detect discernible reductions in poliovirus fitness. For example, replacement of 3 to 14 Arg codons in VP1 (0.3% to 1.6% of capsid codons) with CGG (among the least preferred codons in the poliovirus genome) did not result in any apparent reduction in plaque areas. The ability to detect small declines in poliovirus fitness might be improved by replacing the plaque assay, which invariably gives heterogeneous plaques, with a biochemical assay. However, one advantage of the plaque assay and other virus infectivity assays is their high sensitivities to very low levels of biological activity.

Example 4

In Vivo Protein Synthesis by Deoptimized Pathogen Sequences

This example describes methods used to determine if there was a change in the amount of protein synthesis due to the presence of deoptimized codons. Similar methods can be used to measure protein synthesis by any deoptimized pathogen sequence.

Monolayer HeLa cells were plated at $8 \times 10^5$ per well in a 6-well dish. On the following day, the cells were washed in MEM without serum. Cells were infected at a multiplicity of infection (moi) of 25 in complete MEM with 2% serum. Cells were incubated in a $CO_2$ incubator at 35° C. or 37° C. for 4 hours. Viruses tested were Sabin 2 and MEF1; constructs tested were S2R9 (Sabin 2 prototype genome; ABCD; SEQ ID NO: 3), S2R19 (deoptimized VP3-VP1 genome; ABCd), S2R23 (deoptimized P1/capsid region; abcd; SEQ ID NO: 5), MEF1R2 (MEF1 prototype genome; ABC), MEF1R5 (deoptimized VP3-VP1 genome; ABc), and MEF1R9 (deoptimized P1/capsid region; abc).

Media was removed, and 1.9 ml. of labeling media (200 uCi 35S-met in a mixture of 1 volume regular complete MEM containing 2% serum and 7 volumes of met-deficient complete MEM containing 2% serum) were added. Cultures were incubated in $CO_2$ incubator at 35 or 37° C. for 3 hours. Radioactive media was removed, and cells were rinsed twice with PBS. Cells were lysed in 1 ml lysis buffer (10 mM NaCl, 10 mM Tris-Cl pH 7.5, 1.5 mM $MgCl_2$, containing 1% NP-40) at 35° C. for one minute. The lysed cell-media mixture was transferred to a screw-cap Eppendorf tube on ice. 0.2 ml. lysis buffer was added to the plate, and this lysate was added to the original lysate. The lysate was spun at 2000×g 2 minutes 4° C., and the supernatant was removed to a new tube. SDS was added to the sup to make a final concentration of 1% SDS, and samples were frozen. Samples (4 μl) were run on SDS-10% PAGE gels (Laemmli). Gels were fixed, washed, dried on a vacuum gel drier, and exposed to Kodak BioMax film for 1-3 days at room temperature.

Although it was thought that replacement of preferred codons with unpreferred codons would lower replicative fitness primarily by reducing the rate of translation (at the level of polypeptide chain elongation) of viral proteins and potentially disrupting their proteolytic processing in infected cells, unexpectedly, it was observed that the electrophoretic profiles of the labeled virus-specific proteins were similar for all S2R viruses, both in the relative intensities of the labeled viral protein bands and in the total amounts of labeled viral proteins produced in the infected cells (FIG. 5A). The four S2R viruses were similar in the efficiency of shutoff of host cell protein synthesis and in the synthesis and processing of viral proteins in infected HeLa cells. Similar results were obtained with MEF1 viruses (see Example 10, FIG. 5C).

Example 5

In Vitro Translation

This example describes methods used to determine the ability of deoptimized poliovirus RNA transcripts to serve as templates for in vitro translation in rabbit reticulocyte lysates. Similar methods can be used to measure in vitro protein synthesis by any deoptimized pathogen sequence.

For preparation of truncated polio proteins that include the entire capsid protein and terminate in the 2C noncapsid portion of the poliovirus genome, plasmid DNAs were digested with SnaBI. Full-length and partial viral RNAs were transcribed as described herein. In vitro-transcribed RNAs were subjected to phenol/chloroform extraction and two successive ammonium acetate isopropanol precipitations, including 70% ethanol washes. The RNA pellets were air-dried for 5 minutes and then resuspended in a small volume of RNAse-free water. The resuspended RNA was quantitated by measuring $OD_{260}$ absorbance in a spectrophotometer.

In vitro translation was performed using a nuclease-treated rabbit reticulocyte lysate (Promega, Madison, Wis.) supplemented with an uninfected HeLa cell extract (Brown and Ehrenfeld Virology 97: 396-405, 1979), according to the manufacturer's instructions. The HeLa extract has been found to improve the fidelity of initiation of translation. Briefly, 35 μl micrococcal nuclease-treated, supplemented rabbit reticulocyte lysate was mixed with 7 μl HeLa cell extract, 1 μl 1 mM amino acid mix (minus methionine), various amounts of RNA (0.2-1 ug), 30 μCi $^{35}$S-met at 15 mCi/ml, and 1 μl RNasin (40 u/ul) in a final volume of 50 μl. The reactions were incubated at 30° C. for 3 hours. Samples (4 μl) were run on SDS-10% PAGE gels (Laemmli). Gels were fixed, washed, dried on a vacuum gel drier, and exposed to Kodak BioMax film for 1-3 days at room temperature.

The efficiency of the poliovirus RNA transcripts to serve as templates for in vitro translation in rabbit reticulocytes was similar for all of the viruses tested (S2R9, S2R19, S2R23, MEF1R1, MEF1R2, MEF1R5, and MEF1R9). No decline in translational efficiency was observed with increasing numbers of replacement codons in the in vitro translation systems tested (FIG. 6). The observation that codon replacement had little detectable effect in vivo upon viral protein synthesis and processing was mirrored by the results of in vitro translation experiments in rabbit reticulocyte lysates. Full-length in vitro transcripts from cDNA constructs ABCD, ABCd, and abcd (S2R9, S2R19, S2R23), ABC, ABc and abc (MEF1R2, MEF1R5, and MEF1R9) programmed the in vitro synthesis and processing of virus-specific proteins with nearly equal efficiency (FIGS. 5B and 5D). The in vivo and in vitro protein synthesis results indicate that the reduced replicative fitness of the codon-replacement viruses is not primarily attributable to impairment of translation and processing of viral proteins.

The protein synthesis results are somewhat surprising, since translational effects have been previously observed when unpreferred codons were introduced into the coding region of some genes of bacteria (Barak et al., *J. Mol. Biol.* 256:676-84, 1996), yeast (Hoekema et al., *Mol. Cell Biol.* 7:2914-24, 1987), yeast, and one animal virus (Zhou et al., *J. Virol.* 73:4972-82, 1999). It is possible that translational effects were not observed because some of the codons that are rarely used in poliovirus genomes are used frequently in highly expressed mammalian genes, such that the levels of the tRNAs for these codons may be high and therefore difficult to deplete. Another possible explanation is that poliovirus RNA is not equivalent to a highly expressed gene, as it is not translated as efficiently as mRNAs of the most highly expressed mammalian genes. Polypeptide chain elongation rates are ~220 amino acids per min for poliovirus in HeLa cells at 37° C. (Rekosh, *J. Virol.* 9:479-87, 1972) compared with ~600 amino acids per min for the α-chain of hemoglobin in rabbit reticulocytes (Hunt et al., *J. Mol. Biol.* 43:123-33, 1969). The translation results do not exclude the possibility that there are local conditions in certain cells in an infected person or animal that result in decreased translational efficiency.

Example 6

Specific Infectivities of Virions of Codon-Replacement Viruses

This example describes methods used to measure the infectivity of the deoptimized Sabin viruses described in Example 2. Similar methods can be used to measure the infectivity of any pathogen with one or more deoptimized sequences.

Virus was propagated in RD cells, liberated by freeze-thaw, and concentrated by precipitation with polyethylene glycol 6000 (Nottay et al., *Virology* 108:405-23, 1981). Virions were purified by pelleting, isopycnic centrifugation in CsCl, and repelleting essentially as described by Nottay et al., (*Virology* 108:405-23, 1981). The number of virus particles in each preparation recovered from the CsCl band with a buoyant density of 1.34 g/ml was calculated from the absorbance at 260 nm using the relationship of $9.4\times10^{12}$ virions per $OD_{260}$ unit (Rueckert, R. R. 1976. On the structure and morphogenesis of picornaviruses, p. 131-213. In H. Fraenkel-Conrat and R. R. Wagner (ed.), Comprehensive Virology, vol. 6. Plenum Press, New York.).

The poliovirions produced by HeLa cells infected with viruses ABCD (S2R9), ABCd (S2R19), and abcd (S2R23) were analyzed. Purified infectious virions of all three viruses had similar electrophoretic profiles and the high VP2/VP0 ratios typical of mature capsids. However, the specific infectivities of the purified virions decreased with increased numbers of replacement codons. For example, the particle/PFU ratios increased from 293 (ABCD) to 1221 (ABCd) to 5392 (abcd). The magnitude of the decline in specific infectivity was dependent upon the infectivity assay used, and was steeper with the plaque assay than with the limit dilution assay. This difference arose because the $CCID_{50}$/PFU ratio in HeLa cells increased with the number of replacement codons, from 1.1 (ABCD) to 5.4 (abcd).

Example 7

Measurement of Viral RNA in Infected Cells

Alterations in the primary sequence of the viral genome could affect the levels of RNA in infected HeLa cells by modifying the rates of RNA synthesis or by changing the stabilities of the intracellular viral RNA molecules. This example describes methods used to measure the amount of viral RNA produced in cells infected with the deoptimized viruses described in Example 2. However, one skilled in the art will recognize that similar methods can be used to measure the amount of viral RNA produced in cells infected with any pathogen with one or more deoptimized sequences.

Production of viral RNA in infected HeLa cells during the single-step growth assays described above was measured by quantitative RT-PCR using a Stratagene MX4000 PCR system programmed to incubate at 48° C. for 30 min, 95° C. for 10 min, followed by 60 PCR cycles (95° C. for 15 sec, 60° C. for 1 min). Sequences within the 3' half of the $3D^{pol}$ region of Sabin 2 were amplified using primers S2/7284A (ATTGGCACACTCCTGATTTTAGC; SEQ ID NO: 59) and S2/7195S (CAAAGGATCCCAGAAACACACA; SEQ ID NO: 60), and the amplicon yield measured by the fluorescence at 517 nm of the TaqMan probe S2/7246AB (TTCTTCTTCGCCGTTGTGCCAGG; SEQ ID NO: 61) with FAM attached to the 5' end and BHQ-1 (Biosearch Technologies, Novato, Calif.) attached to the 3' end. Stoichiometric calculations used a value of $2.4 \times 10^6$ for the molecular weight of Sabin 2 RNA (Kitamura, et al., *Nature* 291:547-53, 1981; Toyoda et al., *J. Mol. Biol.* 174:561-85, 1984).

Figure 6A:
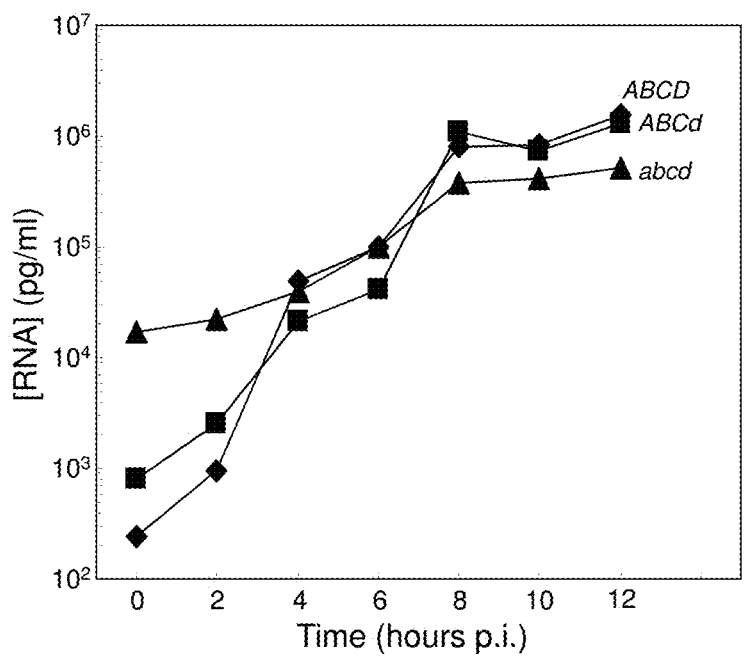
FIGS. 6A and 6B are graphs showing RNA yields from (A) ABCD, ABCd, and abcd Sabin 2 viruses obtained in the single-step growth experiments described in FIGS. 4A and 4B, and for (B) ABC, ABc, and abc MEF1 viruses. RNA levels were determined by quantitative PCR using primers and a probe targeting 3D$^{pol}$ region sequences. One pg of poliovirus RNA corresponds to ~250,000 genomes.

Total levels of viral RNA present in infected HeLa cells were measured at 2 h intervals from 0 to 12 hours in the single-step growth experiments described above and shown in FIGS. 4A and 4B. Viral RNA was measured by quantitative PCR using primers targeting $3D^{pol}$ sequences shared among all viruses. After 12 hours, total viral RNA yields were highest (915 ng/ml; equivalent to ~57,000 RNA molecules/cell) for ABCD, lower (569 ng/ml; ~35,000 RNA molecules/cell) for ABCd, and lowest (330 ng/ml; ~20,000 RNA molecules/cell) for abcd (FIG. 6A). Plaque yields, by contrast, had followed a steeper downward trend, from ~130 PFU/cell (ABCD), to ~30 PFU/cell (ABCd), to ~2 PFU/cell (abcd) (FIGS. 3B and 4A-B). Combining these values, the following yields are obtained: ~440 RNA molecules/PFU (ABCD), ~1200 RNA molecules/PFU (ABCd), and ~10,000 RNA molecules/PFU (abcd). Although the RNA molecules/PFU ratios were similar to the particle/PFU ratios determined above for each virus, the number of RNA molecules produced in infected cells is typically about twice the number of virus particles, because only about 50% of the viral RNA product is encapsidated (Hewlett et al., *Biochem.* 16:2763-7, 1977). Nonetheless, the two sets of values clearly followed similar trends, as RNA yields and specific infectivities declined with increased number of replacement codons.

Because the particle/PFU (or RNA molecule/PFU) ratios were higher for the codon-replacement viruses than for the unmodified ABCD prototype, substantially more ABCd and abcd virion particles were used to initiate the single-step growth infections, even though the input MOIs varied over a narrow (~4-fold) range (FIGS. 4A-B). Consequently, the initial input RNA levels were high for ABCd and very high for abcd, such that the extent of amplification of viral RNA at 12 h was ~4000-fold for ABCD, ~1000-fold for ABCd, and only ~20-fold for abcd (FIG. 6).

The observation that the eclipse phases in the single-step growth experiments were increasingly prolonged as the number of replacement codons increased indicates that codon-replacement viruses were less efficient at completing an early step (or steps) of the infectious cycle. This view is reinforced by the observation that the particle/PFU and RNA molecule/PFU ratios increased sharply with the number of replacement codons. It thus appears that a larger number of codon-replacement virus particles are needed to initiate a replicative cycle, but once the cycle had started the synthesis and processing of viral proteins is nearly normal. Although total viral RNA yield was reduced by only ~3-fold in the most highly modified abcd virus, its viral RNA amplification was only ~20-fold, indicating that impairment of viral RNA synthesis can also contribute to reduced replicative fitness.

Example 8

RNA Secondary Structures of Codon Deoptimized Sequences

This example describes methods used to predict RNA secondary structures of the deoptimized Sabin 2 codon genomes generated in Example 2.

Prediction of the secondary structure of the RNA templates of virus constructs S2R9, S2R19, and S2R23 was performed using the mfold v. 3.1 program (Zuker, *Science* 244: 48-52, 1989; Mathews et al., *J. Mol. Biol.* 288:911-40, 1999; Palmenberg and Sgro, *Semin. Virol.* 8:231-41, 1997) that implements an energy minimization algorithm that finds a structure lying within a percentage (P) of the calculated minimum energy (MinE). Running parameters were set to default except folding temperature (T), which was set to 35° C. The free energy increment ($\Delta\Delta G35°$ C.), dependent on P, is set to 1 kcal/mol or 12 kcal/mol ($SubE_{12}$) when the calculated $\Delta\Delta G35°$ C. values lie below or above these values.

The genomic RNAs of polioviruses and other enteroviruses appear to have relaxed secondary structures outside of the 5'-UTR, the 3'-UTR, and the cre element within the 2C region (Palmenberg and Sgro, *Semin. Virol.* 8:231-41, 1997; Witwer et al., *Nucleic Acids Res.* 29:5079-89, 2001). Accordingly, under physiological conditions, most bases within the ORF can pair with more than one partner, and poliovirus genomes can fold into many different secondary structures having similar thermodynamic stabilities (Palmenberg and Sgro, *Semin. Virol.* 8:231-41, 1997). However, the incorporation of numerous base substitutions into the codon-replacement constructs and the concomitant increase in G+C content might destabilize folding patterns that had been subject to natural selection and stabilize other pairings absent from the unmodified Sabin 2 genome.

Figure 7:
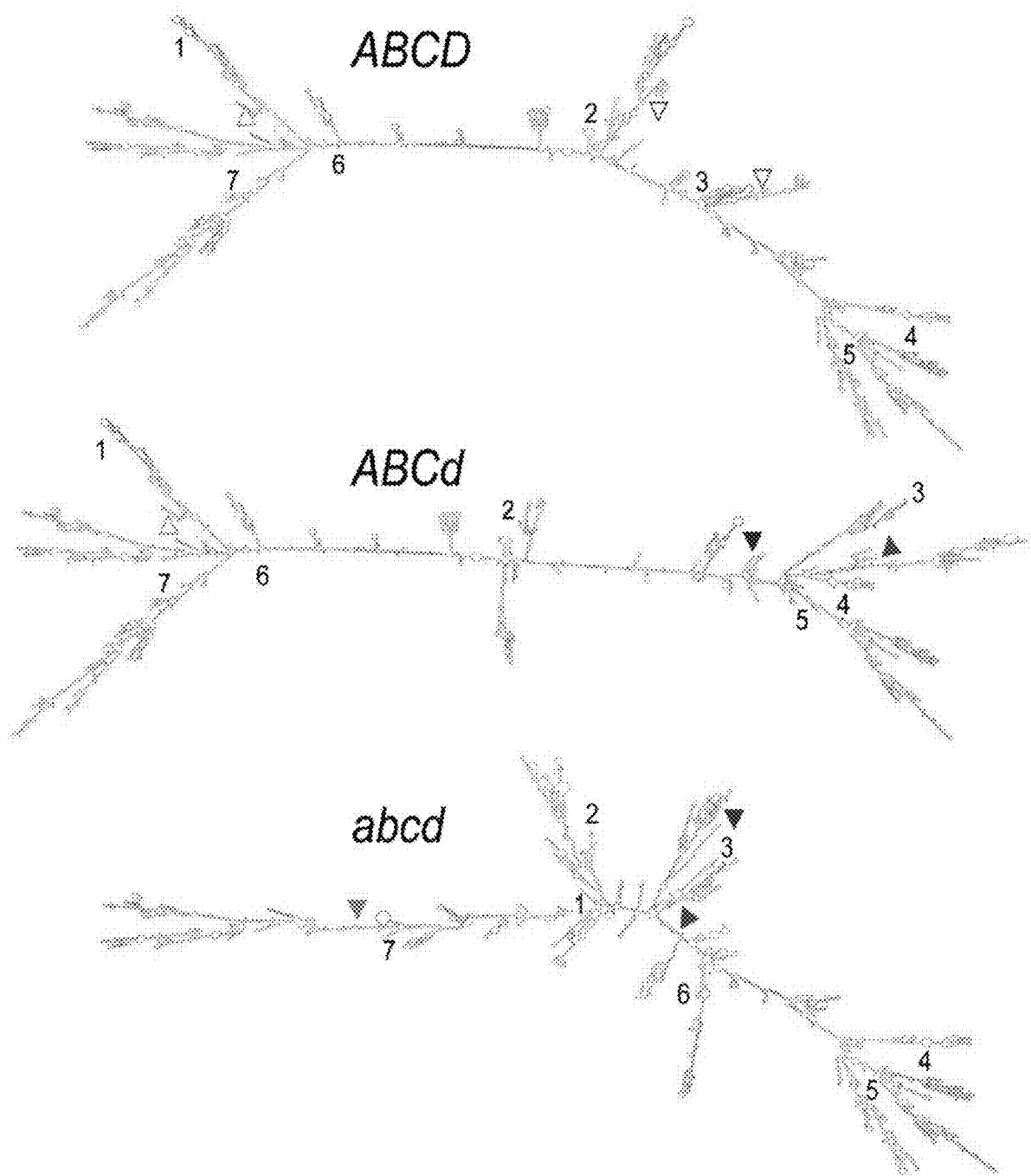
FIG. 7 shows MinE RNA secondary structures for complete genomes of ABCD, ABCd, and abcd viruses calculated by using the mfold algorithm. Base positions are numbered in increments of 1000. Triangles mark boundaries of codon-replacement cassettes: beginning of cassette A (nt 657); beginning of cassette D (nt 2616); end of cassette D (nt 3302). Only intervals bounded by filled triangles had replacement codons.

To determine the effects of codon replacement on RNA folding patterns, the secondary structures of the complete genomes of ABCD, ABCd, and abcd were calculated using the mfold v. 3.1 algorithm. The calculated global thermodynamic stabilities (expressed as minimum free-energy at 35° C. [$\Delta G35°$ C.] or MinE) of the RNA secondary structures increased with increasing G+C content (ABCD, $\Delta G35°$ C.=−2047 kcal/mol; ABCd, $\Delta G35°$ C.=−2078 kcal/mol; abcd, $\Delta G35°$ C.=−2191 kcal/mol), and the number of predicted stem structures increased from 546 (ABCD), to 557 (ABCd), to 562 (abcd). The calculated MinE structures for the three viruses also differed (FIG. 7). However, the in vivo pairings are likely to be much more flexible and dynamic than indicated by the static structures shown in FIG. 7, as many alternative structures having nearly equivalent (+12 kcal/mol) MinE values are predicted (SubE12). A more informative measure of structural rigidity is the p-num value, which gives the number of alternative pairings for each base. Unaltered in all viruses were the stable (low p-num values, colored red) secondary structures in the 5'-UTR, the 3'-UTR, and the cre element, as well as the close apposition of the 5' and 3' termini. However, some folding patterns were modified in the codon-replacement viruses, and the structural perturbations extended beyond the boundaries of the modified cassettes. Alterations in stable pairings were most extensive with abcd, where the long P1/capsid region:P3/noncapsid region pairings (nt 1480-1714:nt 5998-5864) predicted for Sabin 2 RNA were destabilized and other pairings formed (FIG. 7).

Example 9

Stability of the Mutant Phenotypes

This example describes methods used to determine the stability of the codon-deoptimized polioviruses during serial passage in HeLa cells.

Three constructs generated as described in Example 2 were examined: ABCD (unmodified prototype), ABCd (modified VP1 region), and abcd (modified P1/capsid region). Poliovirus constructs S2R9 (ABCD), S2R19 (ABCd), and S2R23 (abcd) were serially passaged in HeLa cell monolayers in T75 flasks at 35° C. for 36 hours, at an input MOI ranging from 0.1 PFU/cell to 0.4 PFU/cell. Each virus was passaged 25 times (at 35° C. for 36 hours), wherein each passage represented at least two rounds of replication. At every fifth passage, virus plaque areas, plaque yields, and the genomic sequences of the bulk virus populations were determined, and the MOI was readjusted to ~0.1 PFU/cell.

All three constructs evolved during serial passage, as measured by increasing plaque size, increasing virus yield, and changing genomic sequences (Table 3; FIGS. 8A-C). Evolution of the ABCD prototype was the least complex. Plaque areas increased ~6-fold from passage 0 to passage 15, and this was accompanied by nucleotide substitutions at 6 sites. By contrast, virus yields increased 2.5-fold over the 25 passages. Two substitutions ($U_{1439} \rightarrow C$ and $C_{2609} \rightarrow U$) were fixed by passage 10, three more ($U_{3424} \rightarrow C$, $A_{3586} \rightarrow G$, and $A_{5501} \rightarrow G$) by passage 15, and all 6 substitutions were fixed by passage 20. Mixed bases were found at passage 5 ($C_{1439}>U$, $C_{2609}>U$, and $U_{3424}>C$), passage 10 ($C_{3424}>U$, $G_{3586}>>A$, and $G_{5501}>A$) and passage 15 ($A_{5630}>U$). No evidence of back mutation or serial substitutions at a site was observed.

TABLE 3

Nucleotide substitutions in ABCD, ABCd, and abcd during passage.

| Virus[a] | Nt Position | RD1 | HeLa5 | HeLa10 | HeLa15 | HeLa20 | HeLa25 | −1 nt[b] | Codon change[c,d,e] | +4 nt[b] | Amino acid subst.[d] | Gene | Location in Poly-protein[f] |
|---|---|---|---|---|---|---|---|---|---|---|---|---|---|
| ABCD | 1439 | U | C > U | C | C | C | C | C | CUU→CCU | G | L→P | VP2 | S: NAg-2 |
| | 2609 | C | C > U | U | U | U | U | U | GCA→GUA | U | A→V | VP1 | I: NC |
| | 3424 | U | U > C | C >> U | C | C | C | C | UAC→CAC | A | Y→H | 2A | NC |
| | 3586 | A | A | G >> A | G | G | G | G | AGA→GGA | A | R→G | 2A | NC |
| | 5501 | A | A | G > A | G | G | G | C | AAA→AGA | G | K→R | 3C | NC |
| | 5630 | A | A | A | A > U | U | U | U | CAG→CUG | G | Q→L | 3C | NC |
| ABCd | 1456 | A | A >> G | A >> G | A > G | A = G | G > A | U | AAC→GAC | C | N→D | VP2 | S: NAg-2 |
| | 2776 | A | A | A | A > G | A > G | A > G | G | AAG→GAG | C | K→E | VP1 | S: NAg-1 |
| | 2780 | G | G >> A | A > G | G > A | G = A | G > A | G | CGG↔CAG | G | R↔Q | VP1 | S: NAg-1 |
| | 3120[g] | G | G | G | G > A | A > G >> C | A > C >> G | U | GCG→GCA | A | A | VP1 | I: C |
| | 3377 | C | C | C | C > U | C > U | C > U | A | ACG↔AUG | A | T↔M | VP1 | I: NC |
| | 3808 | U | U | U | U > C | U > C | U >> C | U | UAU→UGU | G | Y→R | 2A | NC |
| | 3809 | A | A > G | G >> A | G = A | G > A | G >> A | | | | | | |
| | 4350 | A | A > G | G > A | G = A | G > A | G = A | C | UUA↔UUG | U | L | 2C | C |
| abcd | 1169 | G | G | G >> A | A >> G | G > A | G > A | G | CGG↔CAG | A | R↔Q | VP2 | I: C |
| | 1447 | A | A | A | A | A = G | G > A | G | AAC→GAC | G | N→D | VP2 | S: NAg-2 |
| | 1608 | U | U | U | U | U = C | C > U | C | GAU→GAC | A | D | VP2 | I: C |
| | 2622 | C | C | C >> U | U >> C | C > U | C | C | GUC→GUU | G | V | API | I: C |
| | 2633 | C | C | C | U >> C | C >> U | C | U | GCG↔GUG | A | A↔V | VP1 | I: NC |
| | 2903 | A | A | A | A | A = G | G > A | C | AAC→AGC | U | N→S | VP1 | S: NAg-1 |
| | 2915 | C | C | C > U | C >> U | C > U | C >> U | U | GCG↔GUG | A | A↔V | VP1 | ~S: ~NAg-1 |
| | 2986 | A | A | A | A | A = G | G > A | U | AAA→GAA | U | K→E | VP1 | I: V |
| | 3120[g] | G | G > A | G = A | A >> G | A >> G | A >> G | U | GCG→GCA | A | A | VP1 | I: NC |
| | 3121 | A | A | A | A >> C | A > C | A > C | G | AAA→CAA | G | K→Q | VP1 | I: C |
| | 3150 | G | G | G | A > G | G | G | C | ACG→ACA | G | T | VP1 | S: NAg-2 |
| | 3480 | U | U > G | G > U | G >> U | G | G | G | AGU→AGG | G | S→R | 2A | V |
| | 4473 | G | G | G | A > G | A | A | C | AAG→AAA | C | K | 2C | C |

[a]Virus constructs: ABCD, S2R9; ABCd, S2R19; abcd, S2R23.
[b]Nucleotides immediately preceding (−1 nt) and immediately following (+4 nt) codon.
[c]Varying nucleotide is shown in boldface font.
[d]Rightward pointing arrows indicate substitutions that steadily accumulated with increased passage; bidirectional arrows indicate bidirectional fluctuations among substitutions.
[e]CG dinucleotides, including those across codons, are underlined.
[f]Location of amino acid replacements: S, virion surface residue; NAg, neutralizing antigenic site (1, 2); ~NAg, adjacent to neutralizing antigenic site; I, internal capsid residue not exposed to virion surface; NC, non-consensus amino acid; V, variable amino acid.
[g]Represents direct reversion of engineered codon change.

All substitutions mapped to the coding region, and 2 of 6 (33%) mapped to the capsid region, which represents 35.4% of the genome. In distinct contrast to the pattern of poliovirus evolution in humans, where the large majority of base substitutions generate synonymous codons, all six of the observed base substitutions (4 at the second codon position and 2 at the first codon position) generated amino acid replacements (Table 3). None of the substitutions involved loss of a CG dinucleotide.

Evolution of the codon-replacement constructs was more complex and dynamic. In construct ABCd, 4 of the 8 (50%) variable positions mapped to VP1 (12.1% of genome), and 3 of these 4 mapped within the replacement-codon d interval (9.2% of genome) (Table 3). Substitutions at half of the positions involved the apparent loss of CG dinucleotides (6.3% of total genome), although in all instances the loss from the virus population was incomplete. One d interval substitution ($G_{3120} \rightarrow A$) eliminating a CG dinucleotide represented a back mutation to the original synonymous codon. A second d interval substitution ($G_{2780} \rightarrow A$) reduced the frequency of a CG dinucleotide by HeLa passage 10, but the CG dinucleotide predominated in the population by HeLa passage 25. Another substitution ($C_{3377} \rightarrow U$), which resulted in the partial loss of a CG dinucleotide, mapped just downstream from the d interval. Two adjacent substitutions, mapping to positions 3808 and 3809 in 2A, resulted in a complex pattern of substitution involving first and second positions of the same codon. The ABCd construct resembled the ABCD prototype in that substitutions in 6 of the 8 generated amino acid replacements. By contrast, the ABCd construct differed markedly from the ABCD prototype because the dynamics of substitution had apparently not stabilized by passage 25, and mixed bases were found at all 8 positions of variability (Table 3). The active sequence evolution was accompanied by progressively increasing plaque areas over a ~6-fold range, while virus yields fluctuated over a narrow (~2-fold) range (FIGS. 8A-C).

Evolution of the abcd construct was the most dynamic, as determined by expanding plaque areas, increasing virus yields, and nucleotide substitutions. Plaque areas increased ~15-fold from passage 0 to passage 15, and then stabilized (FIGS. 8A-C). Virus yields increased most sharply (~4-fold) between passages 5 and 10, but remained ~4-fold lower than those of the ABCd and ABCd constructs at passage 25 (FIG. 8B). Among the 13 sites of nucleotide variability, most (11/13; 84.6%) mapped to the capsid region, all within the codon-replacement interval, 8 within VP1, 3 within VP2, and none within VP3 (Table 3). As with the other constructs, most (8/13; 61.5%) of the substitutions encoded amino acid replacements. Substitutions at six sites involved partial, transient, or complete loss of CG dinucleotides.

As in the ABCd construct, a $G_{3120} \rightarrow A$ substitution eliminated a CG dinucleotide and restored the original Sabin 2 base. Interestingly, this same reversion was observed in 8 other independent passages of the abcd construct (data not shown). The two variable sites outside of the capsid region (one in 2A, the other in 2C) stabilized with new substitutions by HeLa passage 20, whereas 8 of the 11 variable sites within the capsid region still had mixed bases at passage 25. Apart from the back-mutation at position 3120, all other variable sites differed between the ABCD, ABCd, and abcd constructs. No net changes were observed at site $A_{481}$ (in the 5'-UTR), and $U_{2909}$ (in the VP1 region), known to be strongly selected against when Sabin 2 replicates in the human intestine.

In addition to the elimination of several CG dinucleotides, there was also a net loss (1 lost, 5 partially lost, 1 gained) of UA dinucleotides in the high-passage isolates (Table 3). In the codon-replacement constructs, elimination of UA dinucleotides was incomplete up to passage 25. Most (4 of 6) UA losses involved amino acid replacements. Unlike codons most frequently associated with loss of CG dinucleotides, none of the codons associated with loss of UA dinucleotides were replacement codons. While not as strongly suppressed as CG dinucleotides, UA dinucleotides are underrepresented in poliovirus genomes and human genes.

Most (8 of 13) of the capsid amino acid replacements mapped within or near surface determinants forming neutralizing antigenic sites. For example, four replacements mapped to NAg-1site and four to NAg-2 site (Table 3). Although surface determinants are generally the most variable, amino acid replacements also occurred in naturally variable non-surface residues in VP1 (Lys-Glu) and $2A^{pro}$ (Ser-Arg). Most of the synonymous mutations mapped to codons for conserved amino acids. However, several of the amino acid replacements, including 5 of the 6 in the ABCD construct, were substitutions to non-consensus residues (Table 3).

Sequence evolution in HeLa cells of the unmodified ABCD virus differed in many respects from the codon-replacement ABCd and abcd viruses. Nucleotide substitutions in the ABCD progeny were dispersed across the ORF, dimorphic variants emerged in the early passages, all 6 mutations were fixed by passage 20, and a single dominant master sequence emerged. By contrast, populations of the ABCd and abcd progeny were complex mixtures of variants at least up to passage 25, and the majority base at the variable sites typically fluctuated from passage to passage. Apparently the incorporation of unpreferred codons into the ABCd and abcd genomes led to an expansion of the mutant spectrum and to the emergence of complex and unstable quasispecies populations.

To identify potential critical codon replacements, substitutions that accumulated in the genomes of codon-replacement viruses upon serial passage in HeLa cells were identified. Only one substitution, G3120→A, a direct back mutation to the original sequence, was shared between derivatives of the ABCd and abcd viruses after serial passage. The 19 other independent substitutions found among the ABCd and abcd high-passage derivatives were associated with 12 different codon triplets. Codon replacement in the VP1 region appeared to have proportionately greater effects on replicative fitness than replacements in other capsid intervals, an observation reinforced by the finding that 8 of the 13 sites that varied upon serial passage of abcd mapped to the VP1 region. Replacement of VP1 region codons in the genome of the unrelated wild poliovirus type 2 prototype strain, MEF1, also had a disproportionately high impact on growth.

The pattern of reversion among high-passage progeny of the codon-replacement virus constructs indicates that increased numbers of CG dinucleotides may contribute to the reductions in fitness. The codon replacements raised the number of CG dinucleotides in the poliovirus complete ORFs from 181 (ABCD) to 386 (abcd). Although the biological basis for CG suppression in RNA viruses is poorly understood (Karlin et al., *J. Virol.* 68:2889-97, 1994), selection against CG dinucleotides during serial passage of ABCd and abcd was sufficiently strong at some sites as to drive amino acid substitutions into the normally well conserved poliovirus capsid proteins. In every instance, the CG suppression was incomplete, and was frequently reversed upon further passage. The most stable trends toward CG suppression involved nucleotide positions 3120 and 3150 and were not associated with amino acid changes.

Although fitness of the ABCd and abcd constructs increased during serial passage in HeLa cells, the virus yields of the ABCd and abcd derivatives were still below that of the unmodified ABCD construct. In addition, the substitutions accumulating in the ABCd and abcd derivatives during cell culture passage were distinct from the Sabin 2 mutations known to accumulate during propagation in cell culture, In summary, replicative fitness of both codon-deoptimized and unmodified viruses increased with passage in HeLa cells. After 25 serial passages (~50 replication cycles), most codon modifications were preserved and the relative fitness of the modified viruses remained below that of the unmodified virus. The increased replicative fitness of high-passage modified virus was associated with the elimination of several CG dinucleotides.

Codon replacement in VP1 appeared to have greater relative effects on replicative fitness than replacements in other capsid intervals, an observation confirmed in similar experiments with the wild poliovirus type 2 prototype strain, MEF1, and reinforced by the finding that 8 of the 13 sites that varied upon serial passage of the abcd construct mapped to VP1.

Example 10

Deoptimized Poliovirus MEF1

This example describes methods used to generate a deoptimized MEF1 virus, and the effects of deoptimizing the sequence.

Methods used were similar to those for Sabin 2 (see Example 2). FIGS. 9A-E show a capsid coding sequence for the poliovirus type 2, strain MEF1 which is deoptimized. The prototype strain is listed on the top (SEQ ID NO: 6), the nucleotide codon change is indicated below that line (SEQ ID NO: 8), and the single-letter amino acid code is included as the third line (SEQ ID NO: 7).

Replacement codons were introduced into an infectious cDNA clone derived from MEF1 (MEF1R2) within an interval (nt. 748 to 3297) spanning all but the last 29 codons of the capsid region.

R5 VIRUS Cassette AfeI-XhoI most of VP1 (SEQ ID NO: 54)

R6 VIRUS Cassette EcoRV-AgeI VP4-VP2 (SEQ ID NO: 55)

R7 VIRUS Cassette AgeI-AfeI VP3-partial VP1 (SEQ ID NO: 56)

R8 VIRUS Cassette EcoRV-AfeI VP4-VP2-VP3-partial VP1 (SEQ ID NO: 57)

R9 VIRUS Cassette EcoRV-XhoI Complete capsid (almost) (SEQ ID NO: 58)

Within each cassette, synonymous codons for the nine amino acids were comprehensively replaced except at 2 positions (replacement at 2 of these positions would have generated undesirable restriction sites). Unmodified cassettes were identified by uppercase italic letters; the corresponding cassettes with modified codons were identified by lowercase italic letters. Thus, the reference MEF1R2 clone was identified as ABC (SEQ ID NO: 53), and the fully modified construct (MEF1R9), was identified as abc (SEQ ID NO: 58).

Figure 9G:
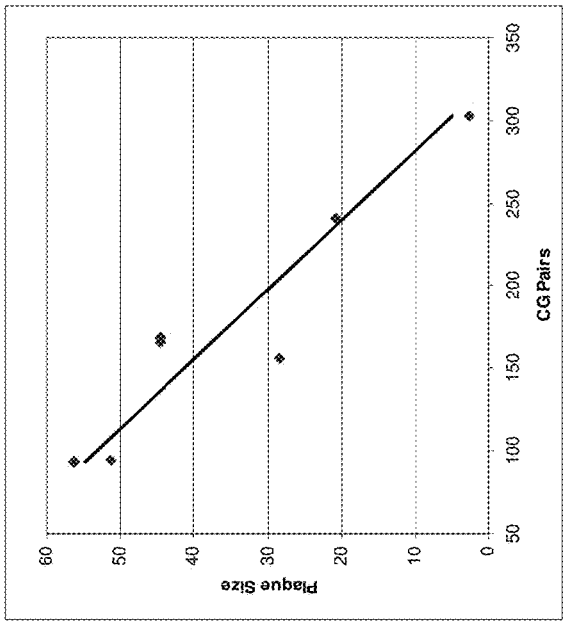
FIG. 9G is a graph showing the inverse linear relationship observed between plaque area and number of CG pairs in MEF1.
Figure 9J:
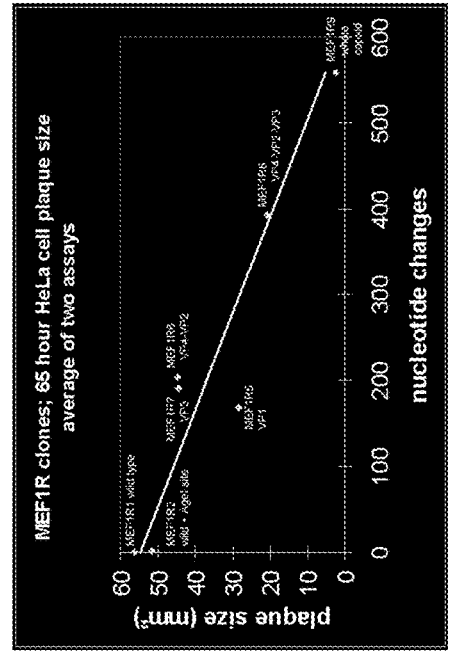
FIG. 9J is a graph showing the inverse linear relationship observed between viral titer and number of nucleotide changes in MEF1.
Figure 9F:
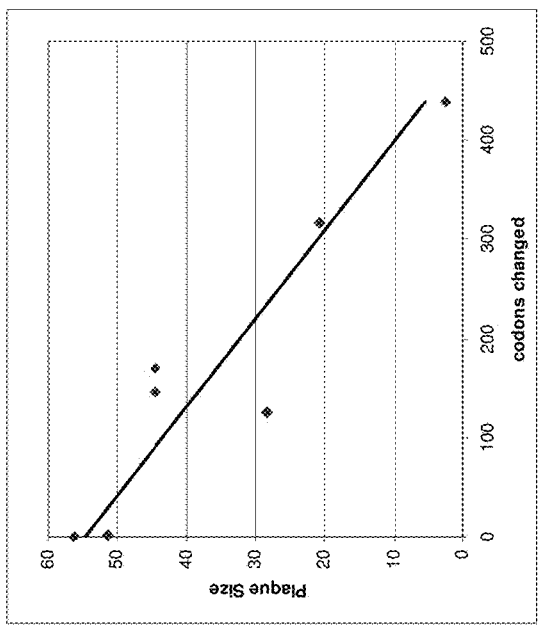
FIG. 9F is a graph showing the inverse linear relationship observed between plaque area and number of replacement codons in MEF1.

The effect of increasing numbers of replacement codons on growth properties was similar to that observed for Sabin 2. An approximately linear inverse relationship was observed between mean plaque area in HeLa cells and the number of nucleotide changes in the capsid region (FIGS. 9F and 9G). Similar inverse linear relationships were observed when the abscissa was rescaled to the number of replacement codons or to the number of CG dinucleotides. There was no strong polarity to the effects of codon replacement within the capsid region, as introduction of replacement codons into any combination of the three cassettes reduced plaque areas approximately in proportion to the total number of replacement codons. However, replacement of codons into VP1 (cassette C) appeared to have slightly stronger effects than replacement elsewhere. Codon replacement across the entire P1/capsid region (construct abc) conferred a minute-plaque phenotype (mean plaque area <25% that of the unmutagenized ABC prototype), and the mean areas of the observed plaques of the abc construct were ~6% of the ABC prototype. Replacements in VP3 and VP4-VP2 that were ~86% of the size of the unmutagenized ABC prototype, underscoring the stronger influence upon plaque size of codon replacement within VP1.

Figure 9I:
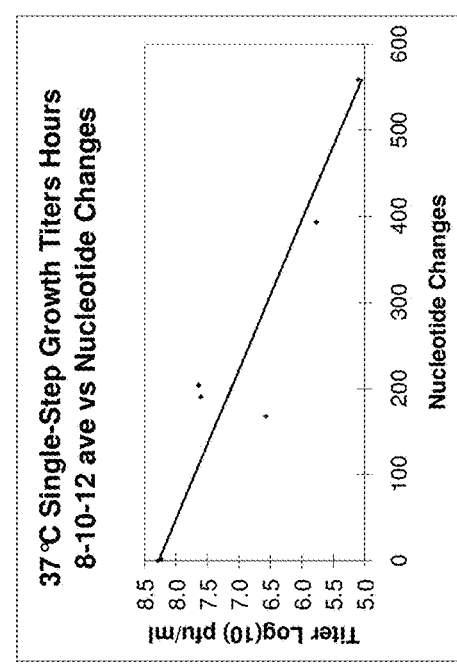
FIG. 9I is a graph showing the inverse linear relationship observed between plaque size and number of nucleotide changes in MEF1.
Figure 9H:
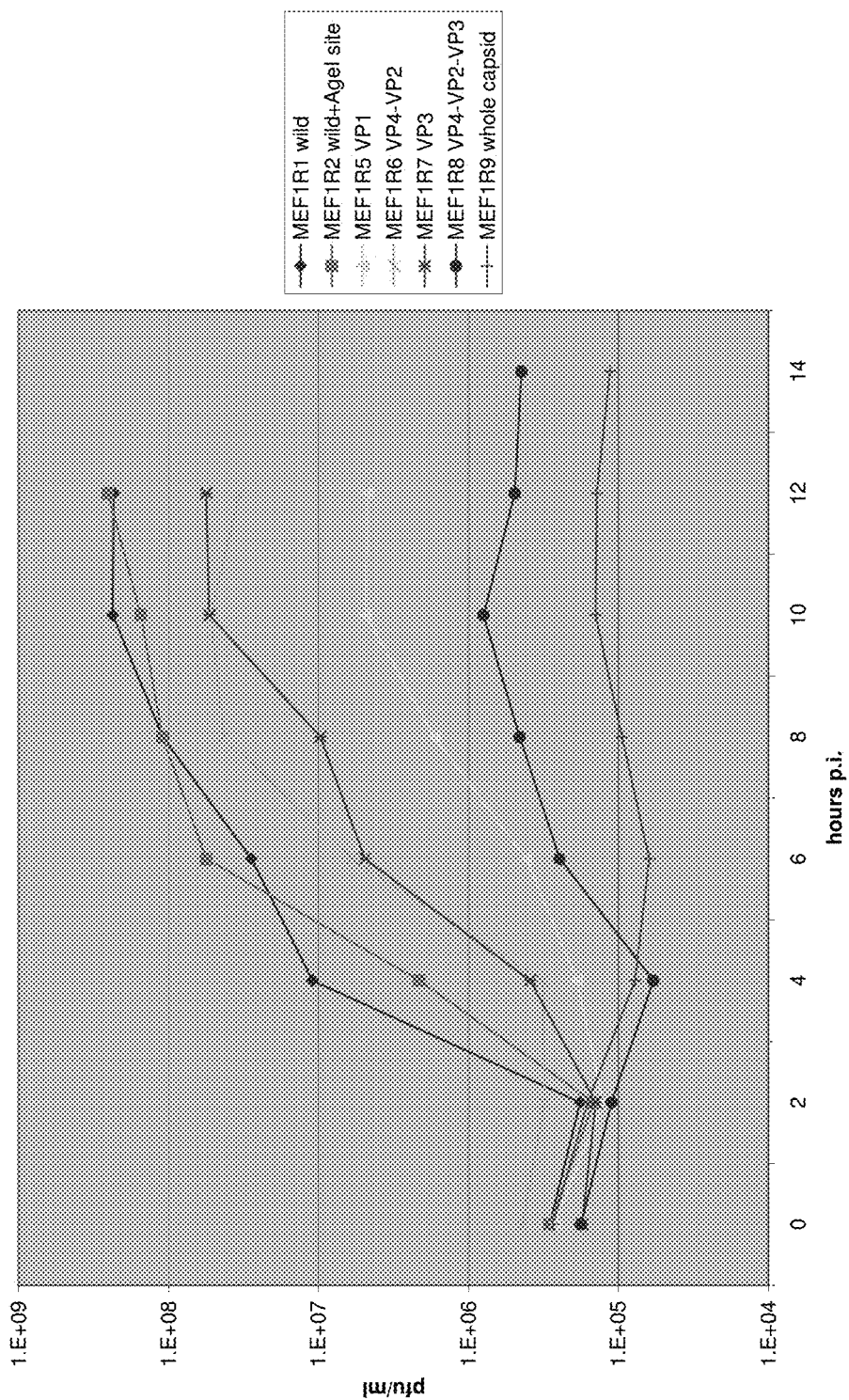
FIG. 9H is a graph showing plaque yields over time for native and deoptimized MEF1 constructs.

Mean virus yields from the single-step growth assays of MEF1 constructs generally decreased as the number of replacement codons increased. As observed for the Sabin 2 codon replacement constructs, production of infectious virus appeared to be slower in the MEF1 codon-replacement constructs than in the unmodified ABC construct. Although maximum plaque yields were obtained at 10-12 hours for all constructs, proportion of the final yields detected at 4 hours were lower for the codon-deoptimized constructs (FIG. 9H). An approximately linear inverse relationship was observed between the log 10 virus yield at 8-12 hours postinfection in the single-step growth curve in HeLa cells and the number of nucleotide changes in the capsid region (FIG. 9I). Plaque size also exhibited a linear inverse relationship with the number of nucleotide changes in the capsid region (FIG. 9J).

The effect on protein translation in vivo and in vitro of the deoptimized MEF viruses was determined using the methods described in Examples 4 and 5. As was observed for the deoptimized Sabin 2 polioviruses, the MEF1 deoptimized viruses had little detectable effect in vivo upon viral protein synthesis and processing (FIG. 5C) or on in vitro translation (FIG. 5D).

Figure 6B:
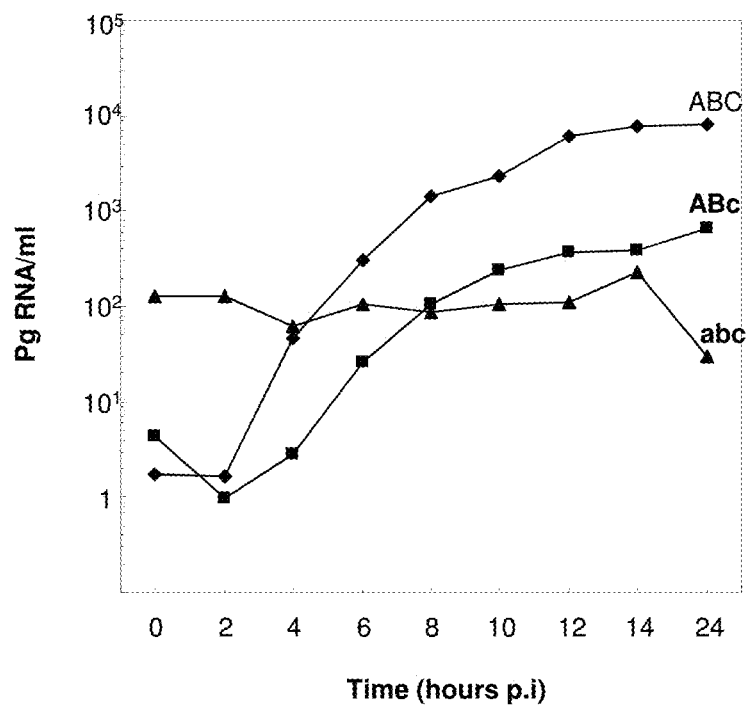

The effect on RNA yields of the deoptimized MEF viruses was determined using the methods described in Example 7, except that the following primers were used to RT-PCR the sequence, CTAAAGATCCCAGAAACACTCA and ATTGGCACACTTCTAATCTTAGC (SEQ ID NOS: 62 and 63), and amplicon yield measured using CTCTTCCTCGC-CATTGTGCCAAG (SEQ ID NO: 64). As was observed for the deoptimized Sabin 2 polioviruses, RNA yields declined with increased number of replacement codons. Total viral RNA yields were highest for ABC, lower for ABc, and lowest for abc (MEF1R9) (FIG. 6B). No increase in viral RNA was observed during the s.s. growth curve for MEF1R9 in HeLa S3 cells.

The MEF1 viruses were purified using the methods described in Example 6. In addition to the virus band at 1.34 g/ml, a large amount of material was observed above the virus band. Some of this material was located where empty capsids might be found in the gradient, but the band was diffuse and quite wide. SDS-PAGE analysis of the material revealed VP0, VP1, VP2 and VP3, which is consistent with an immature virus particle.

The ratio of infectivity on RD cells compared to HeLa cells (CCID50) increased as the numbers of nt substitutions increased (Table 4). The ratio for MEF1R2 was 4, whereas the ratio for MEF1R9 was 40. Codon deoptimization had a bigger determinental effect on the virus titer measured by plaque assay than the virus titer measured by limiting dilution (CCID50) in HeLa cells. For S2R and MEF1R viruses, CCID50 titers were higher than PFU titers (Table 4), with S2R23 and MEF1R9 having the highest ratios of CCID50/PFU. Codon deoptimization had a dramatic effect on the specific infectivity of purified MEF1R viruses, as described for S2R. The particle/HeLa PFU ratios ranged from 182 for MEF1R2 to 18,564 for MEF1R9. The particle/HeLa CCID50s also increased with increased numbers of substitutions, but the effect was more moderate (~4 fold for MEF1R9).

TABLE 4

Infectivity of native and modified polioviruses

| Purified virus | RD CCID50/ HeLa CCID50 | CCID50/ PFU (HeLa) | Virus particles/ HeLa CCID50 | Virus particles/ HeLa PFU |
|---|---|---|---|---|
| MEF1 nonclone | 1 | 3 | 13 | 63 |
| MEF1R1 | 2 | 5 | 15 | 141 |
| MEF1R2 | 4 | 4 | 14 | 182 |
| MEF1R5 | 6 | 4 | 22 | 368 |
| MEF1R8 | 4 | 8 | 34 | 692 |
| MEF1R9 | 40 | 20 | 49 | 18564 |
| S2R9 | 3 | 6 | 16 | 293 |
| S2R19 | 10 | 7 | 25 | 1221 |
| S2R23 | 13 | 16 | 42 | 5392 |

In summary, the replicative fitness of Sabin 2 and MEF1 in cell culture was reduced by replacement of preferred codons in the capsid region with synonymous unpreferred codons. The reduction in fitness, as measured by plaque area, was approximately proportional to the length of the interval containing replacement codons.

Example 11

Additional Deoptimization of Polioviruses

This example describes additional changes that can be made to the Sabin 2 poliovirus capsid sequences disclosed in Example 2, or the MEF1 poliovirus sequences disclosed in Example 10. Such modified sequences can be used in an immunogenic composition In one example, the codon deoptimized Sabin 2 poliovirus capsid sequences disclosed in Example 2 (such as SEQ ID NO: 5), or the codon deoptimized MEF1 poliovirus capsid sequences disclosed in Example 10 (such as SEQ ID NO: 58) can be further deoptimized. For example, additional codon substitutions (for example AUA (Ile), AAA (Lys), and CAU (His)), as well as and redesigned codon substitutions (for example UCG (Ser)) codon substitutions, which are better matched to the least abundant tRNA genes in the human genome (International Human Genome Sequencing Consortium. *Nature* 409:860-921, 2001), can be used to further impair translational efficiency and reduce replicative fitness. Such substitutions can be made using routine molecular biology methods.

Example 12

Additional Methods to Decrease Replicative Fitness

This example describes additional or alternative substitutions that can be made to a pathogen sequence to increase the replicative fitness of a pathogen. In addition to changing codon usage, alterations in G+C content and the frequency of CG or TA dinucleotide pairs can be used to decrease the replicative fitness of a pathogen. For example, a pathogen sequence that includes one or more deoptimized codons can further include an alteration in the overall G+C content of the sequence, such as an increase or decrease of at least 10% in the G+C content in the coding sequence (for example without altering the amino acid sequence of the encoded protein). In another or additional example, a pathogen sequence that includes one or more deoptimized codons can further include an alteration in the number of CG or TA dinucleotides in the sequence, such as an increase or decrease of at least 20% in the number of CG or TA dinucleotides in the coding sequence.

Altering G+C Content

The replicative fitness of a pathogen can be altered by changing the G+C content of a pathogen coding sequence. For example, to increase the G+C content, codons used less frequently by the pathogen that include a "G" or "C" in the third position instead of an "A" or "T" can be incorporated into the deoptimized sequence. Such methods can be used in combination with the other methods disclosed herein for decreasing replicative fitness of a pathogen, for example in combination with deoptimizing codon sequences or altering the frequency of CG or TA dinucleotides.

In one example, the G+C content of a pathogen coding sequence is reduced to decrease replicative fitness. For example, the G+C content of a rubella virus coding sequence can be reduced to decrease replicative fitness of this virus. In one example, the G+C content of a rubella sequence is decreased by at least 10%, at least 20%, or at least 50%, thereby decreasing replicative fitness of the virus. Methods of replacing C and G nucleotides as well as measuring the replicative fitness of the virus are known in the art, and particular examples are provided herein.

In another example, the G+C content of a pathogen coding sequence is increased to decrease replicative fitness. For example, the G+C content of a poliovirus coding sequence can be reduced to decrease replicative fitness of this virus. In one example, the G+C content of a poliovirus sequence is increased by at least 10%, at least 20%, or at least 50%, thereby decreasing replicative fitness of the virus. Methods of replacing A and T nucleotides with C and G nucleotides are known in the art, and particular examples are provided herein.

Altering Frequency of CG or TA Dinucleotides to Decrease Replicative Fitness

The replicative fitness of a pathogen can be altered by changing the number of CG dinucleotides, the TA dinucleotides, or both, in a pathogen coding sequence. For example, to increase the number of CG dinucleotides in a deoptimized sequence, codons used less frequently by the pathogen that include a CG in the second and third position instead of another dinucleotide can be incorporated into the deoptimized sequence. Such methods can be used in combination with the other methods disclosed herein for decreasing replicative fitness of a pathogen, for example in combination with deoptimizing codon sequences.

The dinucleotides CG and TA (UA) are known to be suppressed in poliovirus genomes (Karlin et al., *J. Virol.* 68:2889-97; Kanaya et al., *J. Mol. Evol.* 53, 290-8; Toyoda et al. *J. Mol. Biol.* 174:561-85). The results described herein with the Sabin 2 constructs indicate that increased numbers of CG and TA dinucleotides are associated with reductions in replicative fitness. Therefore, the number of CG or TA dinucleotides can be increased in polio and other eukaryotic viruses (such as those in which CG is strongly suppressed in the genome) to decrease their replicative fitness. In one example, the number of CG or TA dinucleotides in a virus sequence is increased by at least 10%, at least 30%, at least 100%, or at least 300%, thereby decreasing replicative fitness of the virus. The number of CG dinucleotides, TA dinucleotides, or both can be increased in a viral sequence using routine molecular biology methods, and using the methods disclosed herein. For example, additional CG dinucleotides can be incorporated into the ORF by uniform replacement of degenerate third-position bases with C when the first base of the next codon is G. Replacement of codons specifying conserved amino acids can be used to further stabilize the reduced fitness phenotype, as restoration of fitness may strictly require synonymous mutations.

Exemplary Sequences

Provided herein are exemplary modified Sabin 2 sequences that have silent (synonymous) nucleotide substitutions in the cassette d (VP1 region). Such modified sequences can be used in an immunogenic composition SEQ ID NO: 65 (and FIG. 25) show a Sabin 2 sequence with a reduced number of CG dinucleotides (number of CG dinucleotides reduced by 94%). SEQ ID NO: 66 (and FIG. 26) show a Sabin 2 sequence with a reduced number of both CG dinucleotides and UA dinucleotides (number of CG dinucleotides reduced by 94% and number of TA dinucleotides reduced by 57%). These sequences will likely have similar replicative fitness as a native poliovirus, and therefore can be used as a control.

SEQ ID NO: 67 (and FIG. 27) show a Sabin 2 sequence with an increased number of CG dinucleotides (number of CG dinucleotides increased by 389%). SEQ ID NO: 68 (and FIG. 28) show a Sabin 2 sequence with an increased number of both CG dinucleotides and UA dinucleotides, with a priority placed on increasing CG dinucleotides (number of CG dinucleotides increased by 389% and number of TA dinucleotides increased by 203%). These sequences will likely have reduced replicative fitness compared to a native poliovirus, and therefore can be used in immunogenic compositions.

SEQ ID NO: 69 (and FIG. 29) show a Sabin 2 sequence having maximum codon deoptimization. In this sequence, the least favored codons were selected without reference to CG or TA dinucleotides. This sequences will likely have reduced replicative fitness compared to a native poliovirus, and therefore can be used in an immunogenic composition.

SEQ ID NO: 70 (and FIG. 30) show a Sabin 2 sequence using MEF1 codons for Sabin 2 amino acids. This provides a means of using different, naturally occurring codons. This sequences will likely have similar replicative fitness as a native poliovirus, and therefore can be used as a control.

Example 13

Determination of the Replication Steps Altered in Highly Modified Viruses

This example describes methods that can be used to identify the defective replication step in a virus whose coding sequence has been altered to reduce replicative fitness of the virus.

A modified virus, such as a highly modified viruses (for example S2R23 (SEQ ID NO: 5) and MEF1R9 (SEQ ID NO: 58)) can be screened using routine methods in the art. For example, the effects of deoptimizing codons on virus binding, eclipse, uncoating, and particle elution steps can be determined using known methods (Kirkegaard, *J. Virol.* 64:195-206 and Labadie et al. *Virology* 318:66-78, 2004, both herein incorporated by reference as to the methods). Briefly, binding assays (Kirkegaard, *J. Virol.* 64:195-206) could involve determining the percentage of $^3$H-labeled virions onto HeLa or other cells. After incubation with $^3$H-labeled purified poliovirus (such as those shown in SEQ ID NOS: 5 and 58), cells are washed extensively with PBS and the initial and remaining radioactivity counts determined by tricholoroacetic acid precipitation and filtering of the labeled particles.

For conformational alteration assays (Kirkegaard, *J. Virol.* 64:195-206), polioviruses (such as those shown in SEQ ID NOS: 5 and 58) are prebound to a HeLa monolayer at 4° C. for 60 minutes at MOIs of 0.1 PFU/cell. The monolayers are washed three times with PBS and incubated for various time periods at 35° C. Cells are harvested by scraping, and cytoplasmic extracts are titered by plaque assay on HeLa cells. An alternate method (Pelletier et al., *Virol.* 305:55-65) is to use [$^{35}$S]-methionine-labeled purified virus particles. Infections are synchronized by a 2.5-hour period of adsorption at 0° C., and then conformational transitions initiated by incubation at 37° C. for 3 or 10 minutes. Cell-associated virus particles are separated by centrifugation in sucrose gradients (15-30% w/v) (Pelletier et al., *Cell. Mol. Life Sci.* 54:1385-402, 1998).

For RNA release assays (Kirkegaard, *J. Virol.* 64:195-206), neutral red-containing virus is prepared by harvesting virus (such as those shown in SEQ ID NOS: 5 and 58) from HeLa monolayer grown in the presence of 10 µg of neutral red per ml. Time courses of RNA release are determined by pre-binding approximately 200 PFU of each virus to HeLa monolayers at 4° C. for 60 minutes, followed by washing twice with PBS, and agar overlay. Duplicate plates are irradiated for 8 minutes after various times of incubation at 35° C. The numbers of plaques on the irradiated plates are expressed as a percentage of the number of plaques on the unirradiated control.

Protein synthesis and the kinetics of host cell shutoff of protein synthesis can be determined by using pulse-chase experiments in infected cells and other standard methods. Pactamycin will be used to study translational elongation rates (Rekosh, *J. Virol.* 9:479-487). The spectrum of virus particles produced by highly modified viruses can be characterized using fractions from a CsCl density gradient.

Infectivities in different cell types, such as Vero (African green monkey cell line) and human (and possibly murine) neuroblastoma cell lines, can also be determined using routine methods, such as those disclosed herein.

Example 14

Deoptimized Picornaviruses

Examples 14-17 describe methods that can be used to generate a deoptimized positive-strand RNA virus. This example describes methods that can be used to generate a deoptimized Picornavirus sequence, which can be used in an immunogenic composition. Particular examples of foot-and-mouth disease virus (FMDV) and polioviruses are described. However, one skilled in the art will appreciate that similar (and in some examples the same) substitutions can be made to any Picornavirus.

Figure 24J:

Sequences for FMDV are publicly available (for example see GenBank Accession Nos: AJ539141; AY333431; NC_003992; NC_011452; NC_004915; NC_004004; NC_002554; AY593852; AY593851; AY593850; and AY593849). Using publicly available FMDV sequences, along with publicly available codon usage tables from FMDV (for example see Sanchez et al., *J. Virol.* 77:452-9, 2003; and Boothroyd et al., *Gene* 17:153-61, 1982, herein incorporated by reference and FIG. 24A), one can generate deoptimized FMDV sequences.

Using the methods described above in Examples 1 and 2, the capsid of FMDV can be deoptimized. FIGS. 10A-B (and SEQ ID NO: 11) show an exemplary FMDV, serotype O strain UKG/35/2001 capsid sequence having codons deoptimized for 9 amino acids (see Table 5). FMDV containing these substitutions can be generated using standard molecular biology methods. In addition, based on the deoptimized codons provided in Table 5, one or more other FMDV coding sequences can be deoptimized. In addition, the methods described in Example 12 can be used to alter the G+C content or the number of CG or TA dinucleotides in an FMDV coding sequence, for example to further decrease the replicative fitness of FMDV.

TABLE 5

Deoptimized FMDV codons

| Amino acid | Deoptimized codon |
|---|---|
| Pro | CCG |
| Val | GTA |
| Gly | GGG |
| Ala | GCG |
| Ile | ATA |
| Thr | ACG |
| Leu | CTA |
| Ser | TCG |
| Arg | CGA |

Sequences for poliovirus are publicly available (for example see GenBank Accession Nos: AF111984; NC_002058; AY560657; AY278553; AY278552; AY278551; AY278550; AY27849; AF538843; AF538842; AF538840; AY177685; AY184221; AY184220; AY184219; and AY238473). Using publicly available human poliovirus sequences, along with publicly available codon usage tables for poliovirus (Rothberg and Wimmer, *Nucleic Acids Res.* 9:6221-9, 1981, as well as the tables disclosed herein), one can generate deoptimized poliovirus sequences.

Using the methods described above (for example see Examples 1 and 2), the capsid of poliovirus can be deoptimized. FIGS. 9A-E (SEQ ID NO: 8) shows an exemplary poliovirus type 2, strain MEF1 capsid sequence having all Arg codons deoptimized to CGG. Poliovirus containing these substitutions can be generated using standard molecular biology methods.

Similarly, using the methods described above (for example, see Examples 1 and 2), poliovirus types 1 and 3 can be deoptimized (for example by deoptimization of the capsid sequence). For example, the neurovirulent wild strains type 1 Mahoney/USA41 (POLIO1B; GenBank Accession No: V01149) and type 3 Leon/USA37 (POL3L37; GenBank Accession No: K01392), and their Sabin strain derivatives LSc 2ab (Sabin type 1) (GenBank Accession No: V01150), and Leon 12 $a_1b$ (Sabin type 3) (GenBank Accession No: X00596) can be deoptimized.

Example 15

Deoptimized Coronaviruses

This example describes methods that can be used to generate a deoptimized Coronavirus sequence, which can be used in an immunogenic composition. A particular example of a SARS virus is described. However, one skilled in the art will appreciate that similar (and in some examples the same) substitutions can be made to any Coronavirus.

Sequences for SARS are publicly available (for example, see GenBank Accession Nos: NC_004718 (SEQ ID NO: 71); AY654624 (SEQ ID NO: 72); AY595412 (SEQ ID NO: 73); AY394850 (SEQ ID NO: 74); AY559097 (SEQ ID NO: 75); AY559096 (SEQ ID NO: 76); AY559095 (SEQ ID NO: 77); AY559094 (SEQ ID NO: 78); AY559093 (SEQ ID NO: 79); AY559092 (SEQ ID NO: 80); AY559091 (SEQ ID NO: 81); AY559090 (SEQ ID NO: 82); AY559089 (SEQ ID NO: 83); AY559088 (SEQ ID NO: 84); AY274119 (SEQ ID NO: 85); and AY278741 (SEQ ID NO: 86)). Using publicly available SARS sequences, along with publicly available codon usage tables from SARS (for example, see Rota et al., *Science* 300:1394-1399, 2003, herein incorporated by reference, and FIG. 24B), one can generate deoptimized SARS sequences.

Figure 11B:
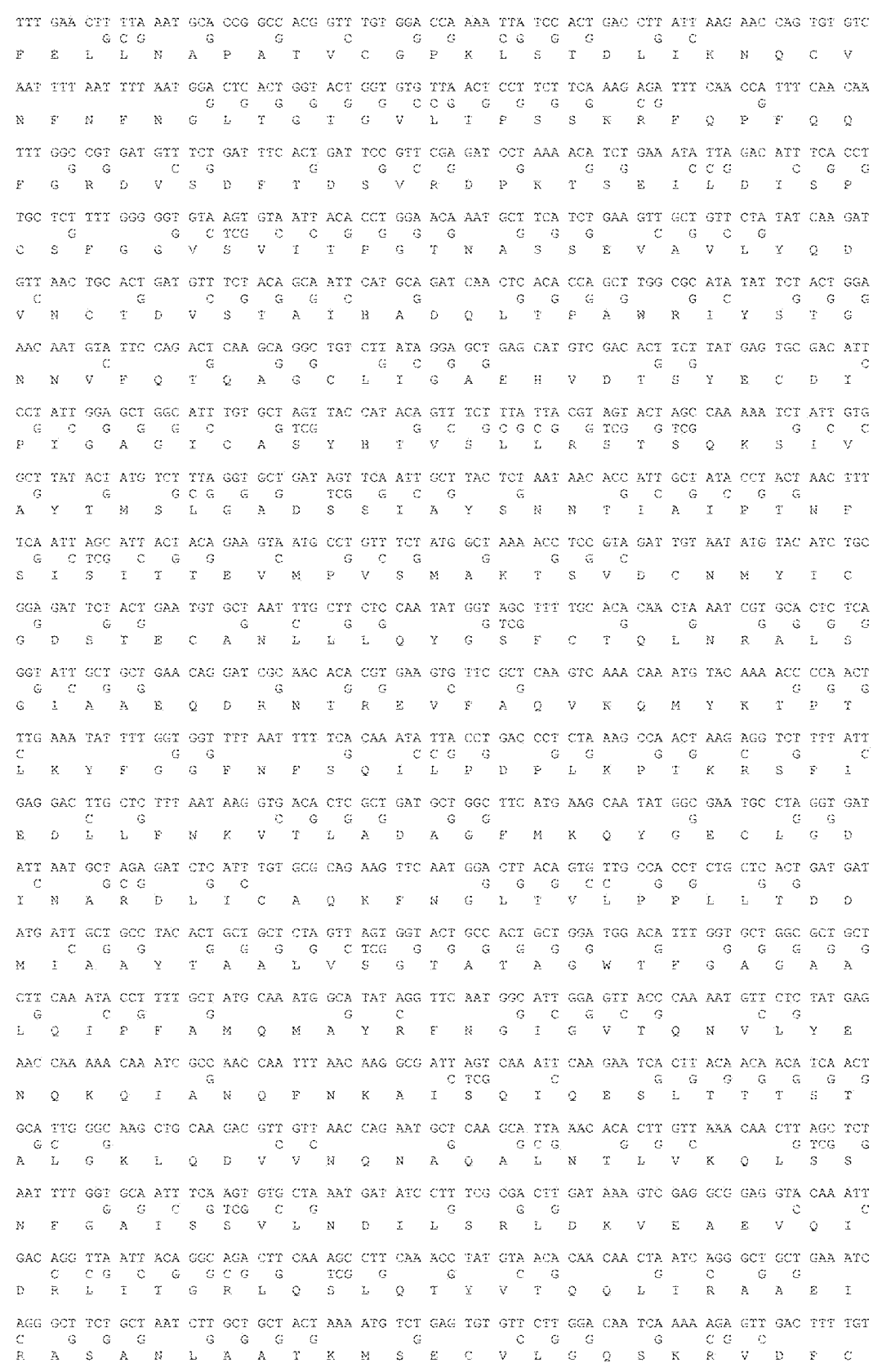

Using the methods described above in Examples 1 and 2, the spike glycoprotein of SARS can be deoptimized. FIGS. 11A-C (and SEQ ID NO: 14) shows an exemplary SARS, strain Urbani spike glycoprotein sequence having codons deoptimized for 9 amino acids (see Table 6). SARS containing these substitutions can be generated using standard molecular biology methods. In addition, based on the deoptimized codons provided in Table 6, one or more SARS coding sequences can be deoptimized. Furthermore, the methods described in Example 12 can be used to alter the G+C content or the number of CG or TA dinucleotides in an SARS coding sequence, for example to further decrease the replicative fitness of SARS.

TABLE 6

Deoptimized SARS codons

| Amino acid | Deoptimized codon |
|---|---|
| Pro | CCG |
| Val | GTC |
| Gly | GGG |
| Ala | GCG |
| Ile | ATC |
| Thr | ACG |
| Leu | CTG |
| Ser | TCG |
| Arg | CGG |

Example 16

Deoptimized Togaviruses

This example describes methods that can be used to generate a deoptimized togavirus sequence, which can be used in an immunogenic composition. A particular example of a rubella virus is described. However, one skilled in the art will appreciate that similar (and in some examples the same) substitutions can be made to any togavirus.

Sequences for rubella virus are publicly available (for example see GenBank Accession Nos: L78917; NC_001545; AF435866; AF188704 and AB047329). Using publicly available rubella sequences, along with publicly available codon usage tables from rubella virus (for example see Nakamura et al., *Nucleic Acids Res.* 28:292, 2000 and FIG. 24C), one can generate deoptimized rubella virus sequences. Similar methods can be used to generate a deoptimized sequence for any togavirus.

Using the methods described above in Examples 1 and 2, the coding sequence of a togavirus can be deoptimized. FIGS. 12A-G (and SEQ ID NO: 18) shows an exemplary rubella virus sequence having codons deoptimized for 10 amino acids (see Table 7). Rubella viruses containing the substitutions shown in FIG. 11 can be generated using standard molecular biology methods. In addition, based on the deoptimized codons provided in Table 7, one or more other rubella coding sequences can be deoptimized. Furthermore, the methods described in Example 12 can be used to alter the G+C content or the number of CG or TA dinucleotides in a rubella coding sequence, for example to further decrease the replicative fitness of rubella.

TABLE 7

Deoptimized rubella codons

| Amino acid | Deoptimized codon |
|---|---|
| Gly | GGA |
| Ala | GCA |
| Val | GTA |
| Thr | ACA |
| Cys | TGT |
| Tyr | TAT |
| Leu | TTA |
| Ser | TCA |
| Arg | AGA |
| Pro | CCA |

Example 17

Deoptimized Flaviviruses

This example describes methods that can be used to generate a deoptimized flavivirus sequence, which can be used in an immunogenic composition. Particular examples of a Dengue I and Dengue II viruses are described. However, one skilled in the art will appreciate that similar (and in some examples the same) substitutions can be made to any flavivirus.

Sequences for Dengue type 1 and Dengue type 2 virus are publicly available (for example see GenBank Accession Nos: M87512; U88535 and U88536 for type 1 and M19197; M29095 and AF022434 for type 2). Using publicly available Dengue 1 and Dengue 2 sequences, along with publicly available codon usage tables from Dengue type 1 and Dengue type 2 virus (for example see Nakamura et al., *Nucleic Acids Res.* 28:292, 2000 and FIGS. 22 D and E, respectively), one can generate deoptimized Dengue type I and Dengue type II virus sequences. Similar methods can be used to generate a deoptimized sequence for any flavivirus.

Using the methods described above in Examples 1 and 2, the coding sequence of a flavivirus can be deoptimized. Flaviviruses, such as Dengue type 1 and 2 viruses, containing these substitutions can be generated using standard molecular biology methods, based on the deoptimized codons provided in Tables 8 and 9. Furthermore, the methods described in Example 12 can be used to alter the G+C content or the number of CG or TA dinucleotides in a Flavivirus coding sequence, for example to further decrease the replicative fitness of the Flavivirus.

TABLE 8

Deoptimized dengue type 1 codons

| Amino acid | Deoptimized codon |
|---|---|
| Gly | GGC |
| Ala | GCG |
| Val | GTA |
| Thr | ACG |
| Leu | CTC |
| Ser | TCG |
| Arg | CGG |
| Pro | CCG |

TABLE 9

Deoptimized dengue type 2 codons

| Amino acid | Deoptimized codon |
|---|---|
| Gly | GGT |
| Ala | GCG |
| Val | GTA |
| Thr | ACG |
| Leu | CTT |
| Ser | TCG |
| Arg | CGG |
| Pro | CCG |

Example 18

Deoptimized Herpesviruses

This example describes methods that can be used to generate a deoptimized herpesvirus sequence, which can be used in an immunogenic composition. A particular example of a varicella-zoster virus (human herpesvirus 3) is described. In addition, provided is a list of deoptimized codon sequences that can be used for HSV-1 or HSV-2, as well as human cytomegalovirus (CMV; human herpesvirus 5). However, one skilled in the art will appreciate that similar (and in some examples the same) substitutions can be made to any herpesvirus.

Sequences for varicella-zoster virus are publicly available (for example see GenBank Accession Nos: NC_001348; AY548170; AY548171; AB097932 and AB097933). Using publicly available varicella-zoster virus sequences, along with publicly available codon usage tables from varicella-zoster virus (for example see Nakamura et al., *Nucleic Acids Res.* 28:292, 2000 and FIG. 24F), one can generate deoptimized varicella-zoster virus sequences.

Using the methods described above in Examples 1 and 2, the gH and gE coding sequence of a herpesvirus can be deoptimized. FIGS. 13A-B and 14A-B (and SEQ ID NOS: 21 and 24) show exemplary varicella-zoster virus gH and gE sequences having codons deoptimized for 9 amino acids (see Table 10). Varicella-zoster virus containing these substitutions can be generated using standard molecular biology methods. Using the methods described above in Examples 1 and 2, and standard molecular biology methods, the coding sequence of one or more VZV genes can be deoptimized. In addition, based on the deoptimized codons provided in Table 10, one or more other VZV coding sequences can be deoptimized. Furthermore, the methods described in Example 12 can be used to alter the G+C content or the number of CG or TA dinucleotides in a VZV coding sequence, for example to further decrease the replicative fitness of the VZV.

TABLE 10

Deoptimized varicella-zoster codons

| Amino acid | Deoptimized codon |
| --- | --- |
| Pro | CCT |
| Val | GTC |
| Gly | GGC |
| Ala | GCT |
| Ile | ATC |
| Thr | ACT |
| Leu | CTA |
| Ser | AGT |
| Arg | AGG |

Sequences for human cytomegalovirus (CMV; human herpesvirus 5) are publicly available (for example see GenBank Accession Nos: AY446894; BK000394; AC146999; NC_001347; and AY315197). Using publicly available CMV sequences, along with publicly available codon usage tables from CMV (for example see Nakamura et al., *Nucleic Acids Res.* 28:292, 2000 and FIG. 24G), one can generate deoptimized CMV sequences.

Table 11 shows CMV deoptimized codon sequences for 9 amino acids. The complete genome of CMV is about 233-236 kb. Using the methods described above in Examples 1 and 2, and standard molecular biology methods, glycoprotein B (UL55), glycoprotein H (UL75), and glycoprotein N (UL73) coding sequences of a CMV can be deoptimized. In addition, based on the deoptimized codons provided in Table 11, one or more other CMV coding sequences can be deoptimized. Furthermore, the methods described in Example 12 can be used to alter the G+C content or the number of CG or TA dinucleotides in a CMV coding sequence, for example to further decrease the replicative fitness of CMV.

TABLE 11

Deoptimized CMV codons

| Amino acid | Deoptimized codon |
| --- | --- |
| Pro | CCA |
| Val | GTT |
| Gly | GGG |
| Ala | GCA |
| Ile | ATA |
| Thr | ACA |
| Leu | TTA |
| Ser | TCA |
| Arg | AGG |

Sequences for herpes simplex virus 1 and 2 (HSV1 and HSV2) are publicly available (for example see GenBank Accession Nos: X14112 and NC_001806 for HSV1 and NC_001798 for HSV2). Using publicly available HSV1 and HSV2 sequences, along with publicly available codon usage tables from HSV1 and HSV2 (for example see Nakamura et al., *Nucleic Acids Res.* 28:292, 2000 and FIG. 24H), one can generate deoptimized HSV1 and HSV2 sequences.

Table 12 shows HSV1 and HSV2 deoptimized codon sequences for 11 amino acids. The codon choices for HSV1 and 2 are very similar and where there are differences they are small. Therefore, the same codon choices can be used for both HSV1 and HSV2. The complete genome of HSV1 and HSV2 is about 152 kb and 155 kb, respectively. Using the methods described above in Examples 1 and 2, and standard molecular biology methods, glycoprotein B (UL27), glycoprotein D (US6), tegument protein host shut-off factor (UL41; see Geiss, *J. Virol.* 74:11137, 2000), and ribonucleotide reductase large subunit (UL39; see Aurelian, *Clin. Diag. Lab. Immunol.* 11:437-445, 2004) coding sequences of HSV1 or HSV2 can be deoptimized. In addition, based on the deoptimized codons provided in Table 12, one or more other HSV1 or HSV2 coding sequences can be deoptimized. Furthermore, the methods described in Example 12 can be used to alter the G+C content or the number of CG or TA dinucleotides in a HSV1 or HSV2 coding sequence, for example to further decrease the replicative fitness of HSV1 or HSV2.

TABLE 12

Deoptimized HSV1 and HSV2 codons

| Codon | HSV 1 | HSV2 |
| --- | --- | --- |
| Pro | CCT | CCA |
| Val | GTA | GTA |
| Gly | GGA | GGT |
| Ala | GCT | GCA |
| Ile | ATA | ATA |
| Thr | ACT | ACT |
| Leu | TTA | TTA |
| Ser | TCA | TCA |
| Arg | AGA | AGA |
| Asn | AAT | AAT |
| Asp | GAT | GAT |

Example 19

Deoptimized Paramyxoviruses

Examples 19 and 20 describe methods that can be used to generate a deoptimized negative-strand RNA virus. This example describes methods that can be used to generate a deoptimized paramyxovirus sequence, which can be used in an immunogenic composition. Particular examples of measles and respiratory syncytial viruses (RSV) are described. However, one skilled in the art will appreciate that similar (and in some examples the same) substitutions can be made to any paramyxovirus.

Sequences for measles and RSV are publicly available (for example see GenBank Accession Nos: NC_001498; AF266287; AY486084; AF266291; and AF266286 for measles; and NC_001781; U63644; AY353550; NC_001803; AF013254 and U39661 for RSV). Using publicly available measles and RSV sequences, along with publicly available codon usage tables from measles and RSV (for example see Nakamura et al., *Nucleic Acids Res.* 28:292, 2000 and FIG. 24I), one can generate deoptimized measles and RSV sequences. Similar methods can be used to generate a deoptimized sequence for any paramyxovirus.

Using the methods described above in Examples 1 and 2, the fusion (F) or hemagglutinin (H) coding sequence of a paramyxovirus can be deoptimized. FIGS. 15A-B and 16A-B show exemplary measles F and G sequences having codons deoptimized for 8 amino acids (SEQ ID NOS: 27 and 30, respectively). FIGS. 17A-B and 18 (and SEQ ID NOS: 33 and 36) show exemplary RSV F and glycoprotein (G) sequences having codons deoptimized for 8 amino acids (see Tables 13 and 14). Measles and RSV viruses containing these substitutions can be generated using standard molecular biology methods. In addition, based on the deoptimized codons provided in Tables 13 and 14, one or more other measles or RSV coding sequences can be deoptimized. Furthermore, the methods described in Example 12 can be used to alter the G+C content or the number of CG or TA dinucleotides in a RSV coding sequence, for example to further decrease the replicative fitness of RSV.

TABLE 13

Deoptimized measles codons

| Amino acid | Deoptimized codon |
|---|---|
| Gly | GGC |
| Ala | GCG |
| Val | GTA |
| Thr | ACG |
| Leu | CTT |
| Ser | TCG |
| Arg | CGC |
| Pro | CCG |

TABLE 14

Deoptimized RSV codons

| Amino acid | Deoptimized codon |
|---|---|
| Gly | GGG |
| Glu | GAG |
| Ala | GCG |
| Thr | ACG |
| Leu | CTG |
| Ser | TCG |
| Arg | CGG |
| Pro | CCG |

Example 20

Deoptimized Orthomyxoviruses

This example describes methods that can be used to generate a deoptimized orthomyxovirus sequence, which can be used in an immunogenic composition. A particular example of an influenza virus is described. However, one skilled in the art will appreciate that similar (and in some examples the same) substitutions can be made to any orthomyxovirus.

Sequences for influenza virus are publicly available (for example see NC_002204 and AY253754). Using publicly available influenza sequences, along with publicly available codon usage tables from influenza (for example see Nakamura et al., Nucleic Acids Res. 28:292, 2000 and FIG. 24J), one can generate deoptimized influenza sequences. Similar methods can be used to generate a deoptimized sequence for any orthomyxovirus.

Using the methods described above in Examples 1 and 2, the hemagglutinin (HA) or neuraminidase (NA) coding sequences of an orthomyxovirus can be deoptimized. FIGS. 17 and 18 show an exemplary influenza virus HA (FIG. 19 and SEQ ID NO: 39) and a NA gene (FIG. 20 and SEQ ID NO: 42) sequence having codons deoptimized for 8 amino acids (see Table 15). Influenza viruses containing these substitutions can be generated using standard molecular biology methods. In addition, based on the deoptimized codons provided in Table 15, one or more other influenza coding sequences can be deoptimized. Furthermore, the methods described in Example 12 can be used to alter the G+C content or the number of CG or TA dinucleotides in an influenza coding sequence, for example to further decrease the replicative fitness of influenza.

TABLE 15

Deoptimized influenza codons

| Amino acid | Deoptimized codon |
|---|---|
| Gly | GGC |
| Ala | GCG |
| Ile | ATC |
| Thr | ACG |
| Leu | TTA |
| Ser | TCG |
| Arg | CGC |
| Pro | CCG |

Example 21

Deoptimized Retroviral Codons

This example describes methods that can be used to generate a deoptimized retrovirus sequence, which can be used in an immunogenic composition. Particular examples of an HIV type 1 (HIV-1), subtype C, retrovirus, and a lentivirus, are described. However, one skilled in the art will appreciate that similar (and in some examples the same) substitutions can be made to any retrovirus.

Sequences for HIV-1 are publicly available (for example see GenBank Accession Nos: AF110967; AY322191; AY682547; AY536234; AY536238; AY332236; AY331296 and AY331288). Using publicly available HIV-1 sequences, along with publicly available codon usage tables from HIV-1 (for example see Nakamura et al., Nucleic Acids Res. 28:292, 2000; Chou and Zhang, AIDS Res. Hum. Retroviruses. 8:1967-76, 1992; Kyprand Mrazek, Nature. 327 (6117):20, 1987, all herein incorporated by reference, and FIG. 24K), one can generate deoptimized HIV-1 sequences. Similar methods can be used to generate a deoptimized sequence for any retrovirus.

Figure 21A:
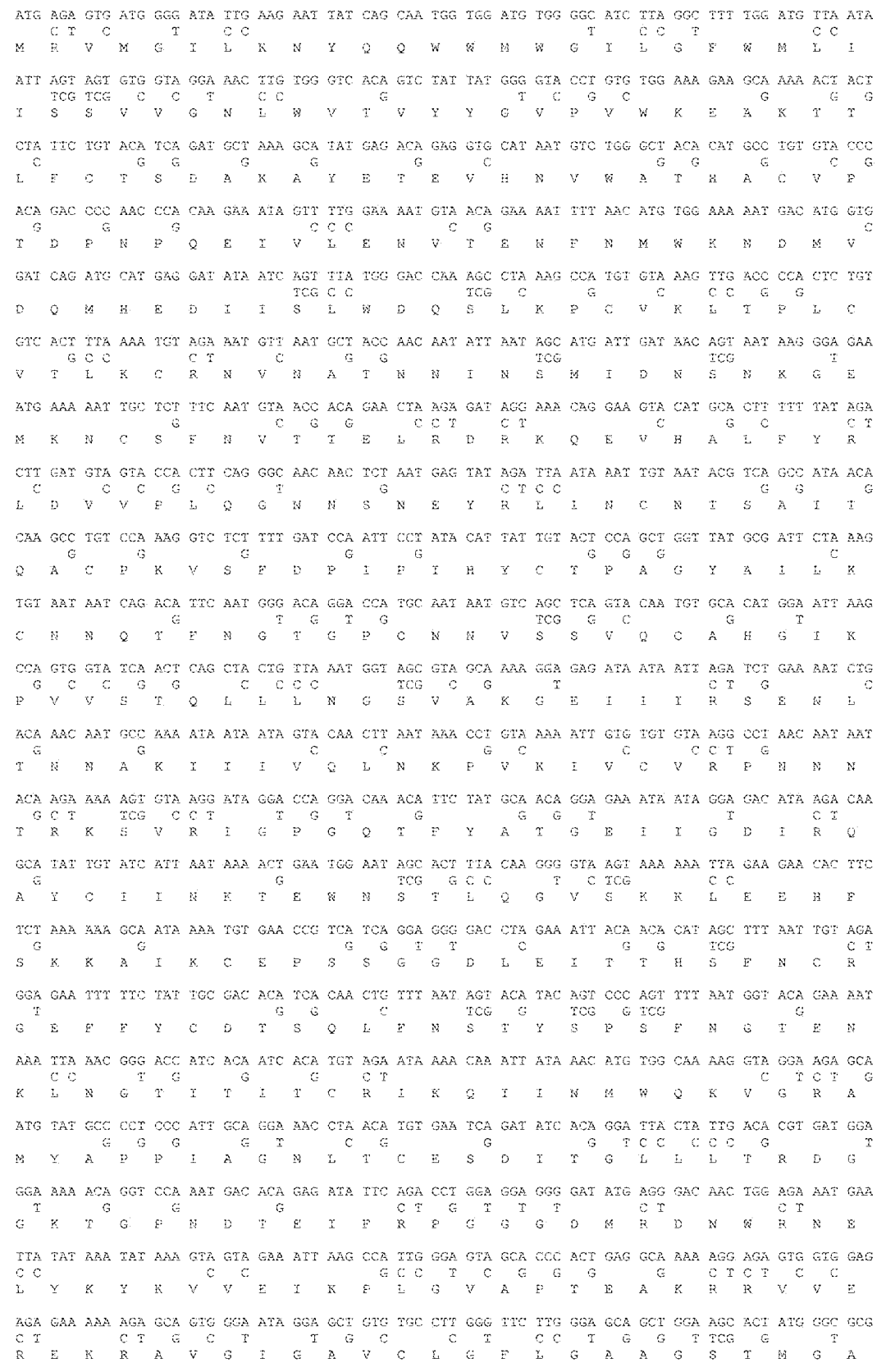

Using the methods described above in Examples 1 and 2, the env coding sequence of HIV-1 can be deoptimized. FIGS. 21A-B (and SEQ ID NO: 45) shows an exemplary HIV-1 env sequence having codons deoptimized for 8 amino acids (see Table 16). HIV-1 containing these substitutions can be generated using standard molecular biology methods. In addition, based on the deoptimized codons provided in Table 16, one or more other HIV-1 coding sequences can be deoptimized. Furthermore, the methods described in Example 12 can be used to alter the G+C content or the number of CG or TA dinucleotides in an HIV-1 coding sequence, for example to further decrease the replicative fitness of HIV-1.

TABLE 16

Deoptimized HIV-1 codons

| Amino acid | Deoptimized codon |
|---|---|
| Gly | GGT |
| Ala | GCG |
| Val | GTC |
| Thr | ACG |
| Leu | CTC |
| Ser | TCG |
| Arg | CGT |
| Pro | CCG |

The equine infectious anemia virus (EIAV) is a lentivirus. Sequences for EIAV are publicly available (for example see GenBank Accession Nos: M87581; X16988; NC_001450 and AF327878). Using publicly available EIAV sequences, along with publicly available codon usage tables from EIAV (for example see Nakamura et al., *Nucleic Acids Res.* 28:292, 2000, herein incorporated by reference, and FIG. 24L), one can generate deoptimized EIAV sequences. Similar methods can be used to generate a deoptimized sequence for any lentivirus.

Using the methods described above in Examples 1 and 2, the env coding sequence of EIAV can be deoptimized, for example using the deoptimized codons provided in Table 17. Furthermore, the methods described in Example 12 can be used to alter the G+C content or the number of CG or TA dinucleotides in an EIAV coding sequence, for example to further decrease the replicative fitness of EIAV.

TABLE 17

| Deoptimized equine infectious anaemia virus (EIAV) codons | |
|---|---|
| Amino acid | Deoptimized codon |
| Gly | GGC |
| Ala | GCG |
| Val | GTC |
| Thr | ACG |
| Leu | CTC |
| Ser | TCG |
| Arg | CGC |
| Pro | CCG |

Example 22

Deoptimized Bacterial Codons

This example describes methods that can be used to generate a deoptimized bacterial sequence, which can be used in an immunogenic composition. Particular optimized *E. coli* sequences are described. However, one skilled in the art will appreciate that similar (and in some examples the same) substitutions can be made to any bacterial coding sequence.

Sequences for *E. coli* are publicly available (for example see GenBank Accession Nos: NC_002695; NC_000913; BA000007; NC_004431; and AE014075). Using publicly available *E. coli* sequences, along with publicly available codon usage tables from *E. coli* (for example see Nakamura et al., *Nucleic Acids Res.* 28:292, 2000 and Sharp et al., *Nucleic Acids Res.* 16:8207-11, 1988, all herein incorporated by reference, and FIG. 24M), one can generate deoptimized *E. coli* sequences. Similar methods can be used to generate a deoptimized sequence for any bacterium.

Using the methods described above in Examples 1 and 2, the ArgS or TufA coding sequences of *E. coli* can be deoptimized. FIGS. 22A-B and 23 shows exemplary *E. coli* ArgS and TufA sequences (and SEQ ID NOS: 48 and 51), respectively, having codons deoptimized for 1 amino acid. *E. coli* containing these substitutions can be generated using standard molecular biology methods. In addition, based on the deoptimized codon provided in Table 18, one or more other *E. coli* coding sequences can be deoptimized. Furthermore, the methods described in Example 12 can be used to alter the G+C content or the number of CG or TA dinucleotides in an *E. coli* coding sequence, for example to further decrease the replicative fitness of *E. coli*.

TABLE 18

| Deoptimized *E. coli* K12 codon | |
|---|---|
| Amino acid | Deoptimized codon |
| Arg | AGG |

Example 23

Pharmaceutical Compositions

The disclosed immunogenic deoptimized pathogenic sequences can be incorporated into pharmaceutical compositions (such as immunogenic compositions or vaccines). Pharmaceutical compositions can include one or more deoptimized pathogenic sequences and a physiologically acceptable carrier. Pharmaceutical compositions also can include an immunostimulant. An immunostimulant is any substance that enhances or potentiates an immune response to an exogenous antigen. Examples of immunostimulants include adjuvants, biodegradable microspheres (such as polylactic galactide microspheres) and liposomes (see, for example, U.S. Pat. No. 4,235,877). Vaccine preparation is generally described, for example, in M. F. Powell and M. J. Newman, eds., *Vaccine Design: the subunit and adjuvant approach*, Plenum Press, N Y, 1995. Pharmaceutical compositions within the scope of the disclosure can include other compounds, which may be either biologically active or inactive.

A pharmaceutical composition can include DNA having a deoptimized coding sequence. The DNA can be present within any of a variety of delivery systems known to those of ordinary skill in the art, including nucleic acid expression systems, bacteria and viral expression systems. Numerous gene delivery techniques are well known in the art, including those described by Rolland, *Crit. Rev. Therap. Drug Carrier Systems* 15: 143-198, 1998, and references cited therein. Appropriate nucleic acid expression systems contain DNA sequences for expression in the subject (such as a suitable promoter and terminating signal). Bacterial delivery systems involve the administration of a bacterium (such as Bacillus-Calmette-Guerrin) that expresses the polypeptide on its cell surface or secretes it. In one example, the DNA is introduced using a viral expression system (such as vaccinia or other pox virus, retrovirus, or adenovirus), which can involve the use of a non-pathogenic (defective), replication competent virus. Suitable systems are disclosed, for example, in Fisher-Hoch et al., *Proc. Natl. Acad. Sci., USA* 86:317-21, 1989; Flexner et al., *Ann. N.Y. Acad. Sci.* 569:86-103, 1989; Flexner et al., *Vaccine* 8:17-21, 1990; U.S. Pat. Nos. 4,603,112, 4,777,127, 4,769,330, and 5,017,487; PCT publications WO 89/01973 and WO 91/02805; Berkner, *Biotechniques* 6:616-27, 1988; Rosenfeld et al., *Science* 252:431-4, 1991; Kolls et al., *Proc. Natl. Acad. Sci. USA* 91:215-9, 1994; Kass-Eisler et al., *Proc. Natl. Acad. Sci. USA* 90:11498-502, 1993; Guzman et al., *Circulation* 88:2838-48, 1993; and Guzman et al., *Cir. Res.* 73:1202-7, 1993. Techniques for incorporating DNA into such expression systems are known. DNA can also be incorporated as "naked DNA," as described, for example, in Ulmer et al., *Science* 259:1745-9, 1993 and Cohen, *Science* 259:1691-2, 1993. Uptake of naked DNA can be increased by coating the DNA onto biodegradable beads.

While any suitable carrier known to those of ordinary skill in the art can be employed in the pharmaceutical compositions, the type of carrier will vary depending on the mode of administration. Pharmaceutical compositions can be formulated for any appropriate manner of administration, including for example, oral (including buccal or sublingual), nasal, rectal, aerosol, topical, intravenous, intraperitoneal, intradermal, intraocular, subcutaneous or intramuscular administration. For parenteral administration, such as subcutaneous injection, exemplary carriers include water, saline, alcohol, fat, wax, buffer, or combinations thereof. For oral administration, any of the above carriers or a solid carrier can be employed. Biodegradable microspheres (such as polylactate polyglycolate) can also be employed as carriers for the pharmaceutical compositions. Suitable biodegradable microspheres are disclosed, for example, in U.S. Pat. Nos. 4,897,268 and 5,075,109.

The disclosed pharmaceutical compositions can also include buffers (such as neutral buffered saline or phosphate buffered saline), carbohydrates (such as glucose, mannose, sucrose or dextrans), mannitol, and additional proteins, polypeptides or amino acids such as glycine, antioxidants, chelating agents such as EDTA or glutathione, and immunostimulants (such as adjuvants, for example, aluminum phosphate) or preservatives.

The compositions of the present disclosure can be formulated as a lyophilizate, or stored at temperatures from about 4° C. to −100° C. Compositions can also be encapsulated within liposomes using well known technology. Furthermore, the compositions can be sterilized, for example, by filtration, radiation, or heat.

Any of a variety of immunostimulants can be employed in the pharmaceutical compositions that include an immunogenically effective amount of attenuated deoptimized pathogen. In some examples, an immunostimulatory composition also includes one or more compounds having adjuvant activity, and can further include a pharmaceutically acceptable carrier.

Adjuvants are non-specific stimulators of the immune system that can enhance the immune response of the host to the immunogenic composition. Some adjuvants contain a substance designed to protect the antigen from rapid catabolism, for example, aluminum hydroxide or mineral oil, and a stimulator of immune responses, such as lipid A, *Bordatella pertussis* or *Mycobacterium tuberculosis* derived proteins. Suitable adjuvants are commercially available as, for example, Merck Adjuvant 65 (Merck and Company, Inc., Rahway, N.J.), TiterMax Gold (TiterMax, Norcross, Ga.), ISA-720 (Seppic, France) ASO-2 (SmithKlineGlaxo, Rixensart, Belgium); aluminum salts such as aluminum hydroxide (for example, Amphogel, Wyeth Laboratories, Madison, N.J.) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and saponins such as quil A and QS-21 (Antigenics, Framingham, Mass.). Cytokines, such as GM-CSF or interleukin-2, -7, or -12, can be used as adjuvants.

The adjuvant composition can be designed to induce an immune response predominantly of the Th1 type. High levels of Th1-type cytokines (such as IFN-γ, TNF-α, IL-2 and IL-12) tend to favor the induction of cell mediated immune responses to an administered antigen. In contrast, high levels of Th2-type cytokines (such as IL-4, IL-5, IL-6 and IL-10) tend to favor the induction of humoral immune responses. Following administration of a pharmaceutical composition as provided herein, a subject may support an immune response that includes Th1- and Th2-type responses. However, in examples where the response is predominantly a Th1-type, the level of Th1-type cytokines increases to a greater extent than the level of Th2-type cytokines. The levels of these cytokines can be readily assessed using standard assays.

Adjuvants for use in eliciting a predominantly Th1-type response include, but are not limited to, a combination of monophosphoryl lipid A, such as 3-de-O-acylated monophosphoryl lipid A (3D-MPL) (Corixa, Hamilton Ind.), together with an aluminum salt. MPL adjuvants are available from Corixa (Seattle, Wash.; see also U.S. Pat. Nos. 4,436, 727; 4,877,611; 4,866,034 and 4,912,094). CG-containing oligonucleotides (in which the CG dinucleotide is unmethylated) also induce a predominantly Th1 response. Such oligonucleotides are well known and are described, for example, in PCT publications WO 96/02555 and WO 99/33488. Immunostimulatory DNA sequences are also described, for example, by Sato et al., *Science* 273:352, 1996. Another adjuvant is a saponin such as QS21 (Antigenics, Framingham, Mass.), which may be used alone or in combination with other adjuvants. For example, an enhanced system involves the combination of a monophosphoryl lipid A and saponin derivative, such as the combination of QS21 and 3D-MPL as described in WO 94/00153, or a less reactogenic composition where the QS21 is quenched with cholesterol, as described in WO 96/33739. Other formulations include an oil-in-water emulsion and tocopherol. An adjuvant formulation involving QS21, 3D-MPL and tocopherol in an oil-in-water emulsion is described in WO 95/17210.

Still further adjuvants include Montanide ISA 720 (Seppic, France), SAF (Chiron, Calif., United States), ISCOMS (CSL), MF-59 (Chiron), the ASO-2 series of adjuvants (SmithKlineGlaxo, Rixensart, Belgium), Detox (Corixa, Seattle, Wash.), RC-529 (Corixa, Seattle, Wash.), Aminoalkyl glucosaminide 4-phosphates (AGPs), copolymer adjuvants, CG oligonucleotide motifs and combinations of CG oligonucleotide motifs, bacterial extracts (such as mycobacterial extracts), detoxified endotoxins, and membrane lipids. Combinations of two or more adjuvants can also be used.

Still other adjuvants include polymers and co-polymers. For example, copolymers such as polyoxyethylene-polyoxypropylene copolymers and block co-polymers can be used. A particular example of a polymeric adjuvant is polymer P1005.

Adjuvants are utilized in an adjuvant amount, which can vary with the adjuvant, subject, and immunogen. Typical amounts of non-emulsion adjuvants can vary from about 1 ng to about 500 mg per administration, for example, from 10 µg to 800 µg, such as from 50 µg to 500 µg. For emulsion adjuvants (oil-in-water and water-in-oil emulsions) the amount of the oil phase can vary from about 0.1% to about 70%, for example between about 0.5% and 5% oil in an oil-in-water emulsion and between about 30% and 70% oil in a water-in-oil emulsion. Those skilled in the art will appreciate appropriate concentrations of adjuvants, and such amounts can be readily determined.

Any pharmaceutical composition provided herein can be prepared using well known methods that result in a combination of deoptimized pathogen (or deoptimized DNA coding sequence), alone or in the presence of an immunostimulant, carrier or excipient, or combinations thereof. Such compositions can be administered as part of a sustained release formulation (such as a capsule, sponge or gel that includes the deoptimized pathogen) that provides a slow release of the composition following administration. Such formulations can be prepared using well known technology (see, for example, Coombes et al., *Vaccine* 14:1429-38, 1996) and administered by, for example, subcutaneous implantation at the desired target site. Sustained-release formulations can contain a deoptimized pathogen dispersed in a carrier matrix or contained within a reservoir surrounded by a rate controlling membrane.

Carriers for use with the disclosed compositions are biocompatible, and can also be biodegradable, and the formulation can provide a relatively constant level of active component release. Suitable carriers include, but are not limited to, microparticles of poly(lactide-co-glycolide), as well as polyacrylate, latex, starch, cellulose and dextran. Other delayed-release carriers include supramolecular biovectors, which comprise a non-liquid hydrophilic core (such as a cross-linked polysaccharide or oligosaccharide) and, optionally, an external layer comprising an amphiphilic compound, such as a phospholipid (see, for example, U.S. Pat. No. 5,151,254 and PCT publications WO 94/20078, WO/94/23701 and WO 96/06638). The amount of active compound contained within a sustained release formulation depends upon the site of implantation, the rate and expected duration of release and the nature of the condition to be treated or prevented.

Any of a variety of delivery vehicles can be employed with the disclosed pharmaceutical compositions to facilitate production of an antigen-specific immune response to a deoptimized pathogen. Exemplary vehicles include, but are not limited to, hydrophilic compounds having a capacity to disperse the deoptimized pathogen and any additives. The deoptimized pathogen can be combined with the vehicle according to methods known in the art. The vehicle can be a solvent or dispersion medium containing, for example, water, ethanol, polyol (for example, glycerol, propylene glycol, liquid polyethylene glycol, and the like), and suitable mixtures thereof. Other exemplary vehicles include, but are not limited to, copolymers of polycarboxylic acids or salts thereof, carboxylic anhydrides (for example, maleic anhydride) with other monomers (for example, methyl (meth) acrylate, acrylic acid and the like), hydrophilic vinyl polymers, such as polyvinyl acetate, polyvinyl alcohol, polyvinylpyrrolidone, cellulose derivatives, such as hydroxymethylcellulose, hydroxypropylcellulose and the like, and natural polymers, such as chitosan, collagen, sodium alginate, gelatin, hyaluronic acid, and nontoxic metal salts thereof.

A biodegradable polymer can be used as a base or vehicle, such as polyglycolic acids and polylactic acids, poly(lactic acid-glycolic acid) copolymer, polyhydroxybutyric acid, poly(hydroxybutyric acid-glycolic acid) copolymer, and mixtures thereof. Other biodegradable or bioerodable polymers include, but are not limited to, such polymers as poly(epsilon-caprolactone), poly(epsilon-aprolactone-CO-lactic acid), poly(epsilon.-aprolactone-CO-glycolic acid), poly(beta-hydroxy butyric acid), poly(alkyl-2-cyanoacrilate), hydrogels, such as poly(hydroxyethyl methacrylate), polyamides, poly(amino acids) (for example, L-leucine, glutamic acid, L-aspartic acid and the like), poly(ester urea), poly(2-hydroxyethyl DL-aspartamide), polyacetal polymers, polyorthoesters, polycarbonate, polymaleamides, polysaccharides, and copolymers thereof. In some examples, vehicles include synthetic fatty acid esters such as polyglycerin fatty acid esters and sucrose fatty acid esters. Hydrophilic polymers and other vehicles can be used alone or in combination, and enhanced structural integrity can be imparted to the vehicle by partial crystallization, ionic bonding, cross-linking and the like.

The vehicle can be provided in a variety of forms, including, fluid or viscous solutions, gels, pastes, powders, microspheres and films. In one example, pharmaceutical compositions for administering a deoptimized pathogen are formulated as a solution, microemulsion, or other ordered structure suitable for high concentration of active ingredients. Proper fluidity for solutions can be maintained, for example, by the use of a coating such as lecithin, by the maintenance of a desired particle size in the case of dispersible formulations, and by the use of surfactants.

Delivery vehicles include antigen presenting cells (APCs), such as dendritic cells, macrophages, B cells, monocytes and other cells that can be engineered to be efficient APCs. Such cells can, but need not, be genetically modified to increase the capacity for presenting the antigen, to improve activation or maintenance of the T cell response, to have anti-pathogen effects, or to be immunologically compatible with the receiver (matched HLA haplotype). APCs can generally be isolated from any of a variety of biological fluids and organs, including tumor and peritumoral tissues, and may be autologous, allogeneic, syngeneic or xenogeneic cells.

In certain examples, the deoptimized pathogen is administered in a time release formulation. These compositions can be prepared with vehicles that protect against rapid release, and are metabolized slowly under physiological conditions following their delivery (for example in the presence of bodily fluids). Examples include, but are not limited to, a polymer, controlled-release microcapsules, and bioadhesive gels. Many methods for preparing such formulations are well known to those skilled in the art (see, for example, *Sustained and Controlled Release Drug Delivery Systems*, J. R. Robinson, ed., Marcel Dekker, Inc., New York, 1978).

Pharmaceutical compositions can be presented in unit-dose or multi-dose containers, such as sealed ampoules or vials. Such containers are typically hermetically sealed to preserve sterility of the formulation until use. In general, formulations can be stored as suspensions, solutions or as emulsions in oily or aqueous vehicles. Alternatively, a pharmaceutical composition can be stored in a freeze-dried condition requiring only the addition of a sterile liquid carrier immediately prior to use.

The pharmaceutical compositions of the disclosure typically are sterile and stable under conditions of manufacture, storage and use. Sterile solutions can be prepared by incorporating the disclosed deoptimized pathogens (alone or in the presence of a pharmaceutically acceptable carrier, adjuvant, or other biologically active agent) in the desired amount in an appropriate solvent followed by sterilization, such as by filtration. Generally, dispersions are prepared by incorporating the deoptimized pathogen into a sterile vehicle that contains a dispersion medium and other desired ingredients. In the case of sterile powders, methods of preparation include vacuum drying and freeze-drying which yields a powder of the deoptimized pathogen plus any additional desired ingredient from a previously sterile-filtered solution thereof. For vaccine use, the deoptimized pathogens of the disclosure can be used directly in vaccine formulations, or lyophilized, as desired, using lyophilization protocols well known in the art. Lyophilized pathogen is typically be maintained at about 4° C. When ready for use the lyophilized pathogen can be reconstituted in a stabilizing solution (such as saline).

Example 24

Methods of Stimulating an Immune Response

This example describes methods using the disclosed immunogenic compositions that can be used to stimulate an immune response in a subject, such as a human. Methods for inoculation are routine in the art. In some examples, a determination is made as to whether the subject would benefit from administration of a deoptimized pathogen sequence, prior to administering the immunogenic composition. Administration can be achieved by any method known in the art, such as oral administration or inoculation (such as intramuscular, ip, or subcutaneous). In some examples, the deoptimized pathogen is administered, for example an inactivated or live pathogen. In particular examples, the deoptimized nucleic acid molecule or protein molecule is administered. In some examples, combinations of these agents are administered, alone or in the presence of other agents, such as an adjuvant.

The amount of deoptimized pathogen (or part thereof such as DNA sequence) administered is sufficient to induce in the host an effective immune response against virulent forms of the pathogen. An effective amount can being readily determined by one skilled in the art, for example using routine trials establishing dose response curves. The immunogenic compositions disclosed herein can be administered to the subject as needed to confer immunity against the pathogen to the subject. For example, the composition can be administered in a single bolus delivery (which can be followed by one or more booster administrations as needed), via continuous delivery over an extended time period, in a repeated administration protocol (for example, by an hourly, daily, weekly, or monthly repeated administration protocol).

In some examples, a deoptimized viral sequence is administered to a subject. The sequence can be administered as a nucleic acid molecule, the virus itself, or combinations thereof. In one example, a deoptimized DNA sequence is administered to the subject, for example in the presence of a carrier molecule, such as a lipid (for example a liposome). The amount of DNA administered can be determined by routine methods in the art. In some examples, the amount of DNA administered (for example by orally or inoculation) is 0.1 μg-1000 μg DNA, such as 10-100 μg DNA, such as at least 10 μg DNA. In particular examples, a deoptimized virus (live or inactivated, and in some examples lyophilized) is administered to the subject (for example orally or via injection). Exemplary doses of virus, include, but are not limited to, $10^3$ to $10^{10}$ plaque forming units (PFU) or more of virus per dose, such as $10^4$ to $10^5$ PFU virus per dose, for example at least $10^3$ PFU virus per dose, at least $10^4$ PFU virus per dose, at least $10^5$ PFU virus per dose, or at least $10^9$ PFU virus per dose.

In some examples, a deoptimized bacterial sequence is administered to a subject. The sequence can be administered as a nucleic acid molecule, or as the bacterium. In examples wherein a deoptimized bacterial DNA sequence is administered, the methods described above can be used. In particular examples, a deoptimized bacterium (such as an inactivated whole-cell vaccine) is administered to the subject (for example orally or via injection). Exemplary doses of bacteria (as measured by colony-forming units), include, but are not limited to, $10^3$-$10^{10}$ bacteria per dose, for example at least $10^3$ bacteria, at least $10^4$ bacteria, at least $10^5$ bacteria, at least $10^8$ bacteria, or at least $10^9$ bacteria per dose.

In some examples, a deoptimized parasitic sequence is administered to a subject. The sequence can be administered as a nucleic acid molecule, or as the parasite. In examples wherein a deoptimized parasitic DNA sequence is administered, the methods described above can be used. In particular examples, a deoptimized parasite (such as a live or inactivated parasite) is administered to the subject (for example orally or via injection). Exemplary doses of parasites, include, but are not limited to, $10^3$-$10^{10}$ parasites per dose, for example at least $10^3$ parasites, at least $10^4$ bacteria, at least $10^5$ parasites, at least $10^8$ parasites, or at least $10^9$ parasites per dose.

Example 25

Attenuated Poliovirus as an Immunogen

This example describes methods that can be used to demonstrate the ability of an attenuated poliovirus to be used as an immunogen.

Wild-Type Mouse Neurovirulence Using Deoptimized MEF1 Viruses

The method of Ford et al. (*Microbial Pathogenesis* 33:97-107, 2002, herein incorporated by reference) can be used. Wild-type mice are infected with the wild type 2 poliovirus strain MEF1. MEF1 is a mouse-adapted type 2 polio strain that cannot infect mice via the oral route, but can infect via injection. Briefly, wild-type mice (such as six-week old, adult, male Swiss mice (Taconic Labs, Germantown, N.Y.)) are anesthetized with isofluorane and subsequently administered the virus via intramuscular injection (right medial gastrocnoemius) utilizing a 26.5 gauge needle. In some examples, the virus is injected into the brain or spinal cord. Mice each are administered approximately $10^1$-$10^{11}$ TCID50 (amount of virus required for 50% infectivity of susceptible cells in tissue culture) of MEF1R2 (an MEF1 clone with an extra silent restriction site; SEQ ID NO: 53), MEF1 (non-clone; SEQ ID NO: 52), MEF1R5 (VP1 alterations; SEQ ID NO: 54), MEF1R9 (SEQ ID NO: 58), or with phospho-buffered saline (PBS) as a negative control.

All inoculated animals are observed daily for signs of disease (paralysis, encephalitis, or death). Paralysis is defined as limb weakness and delineated between spastic/hypertonic and flaccid/hypotonic by a neurologist. Tone is determined by manual manipulation of the limb and compared with normal tone in uninoculated mice. Blood will be collected from mice 21 days after infection. Serum samples are analyzed for the presence of neutralizing antibody to poliovirus. Blood will be collected before euthanasia when necessary.

The following methods can be used to assess immunogenicity of the deoptimized viruses. The presence of neutralizing antibodies can be assessed by using the neutralization test (standard WHO method), as described in Horie et al. (*Appl. Environ. Microbiol.* 68:138-42, 2002). Following immunization, sera is obtained from immunized and non-immunized subjects. About 50 μl of sera dilution series is prepared, in duplicate, in Eagle's minimal essential medium (MEM) supplemented with 2% FCS in a 96-well microtiter plate. Then 50 μl of 100 50% cell culture infectious doses (CCID50) of each isolate, Sabin type 2 vaccine strain, or type 2 wild strain MEF1 is added to each well. After incubation at 36° C. for 2 hours, 100 μl of a cell suspension containing $10^4$ HEp2-C cells in MEM supplemented with 5% FCS are added to each well. The plates are then scored or CPE after 7 days of incubation at 36° C. in a $CO_2$ atmosphere. The calculation of the neutralizing titer of each sample can be determined by the Karber method (see World Health Organization. 1990. Manual for the virological investigation of poliomyelitis. World Health Organization, Expanded Programme on Immunization and Division of Communicable Diseases. W.H.O. publication no. W.H.O./EPI/CDS/POLIO/90.1. World Health Organization, Geneva, Switzerland).

Production of specific neutralizing antibodies when inoculated with codon-deoptimized virus constructs of MEF1 would give evidence of protective immunity. Protection from paralysis upon challenge with dosages of MEF1 sufficient to cause paralysis in unprotected mice would be confirmation of protective immunity.

Transgenic Mice Bearing the Human Poliovirus Receptor

As an alternative to using wild-type mice, transgenic mice expressing the human poliovirus receptor can be used (PVR-Tg21 mice, Central Laboratories for Experimental Animals, Kanagawa, Japan), using the methods described above. Briefly, transgenic PVR-Tg21 mice at 8-10 weeks of age are administered the deoptimized virus (such as a sequence that includes SEQ ID NO: 5 or 58), wild-type virus, other polio virus, or buffer alone. Administration can be by any mode, such as injection into the muscle as described above, intranasal, intraspinal or intracerebral inoculation. However, injection into muscle in some examples requires a higher dose of virus than intraspinal or intracerebral inoculation. Intraspinal injection can be performed as described in Horie et al. (*Appl. Envir. Microbiology* 68:138-142, 2002). Briefly, the desired virus is serially diluted 10-fold, and 5 μl of each dilution inoculated into the spinal cord of 5-10 mice per dilution. Intracerebral injection can be performed as described in Kew et al. (*Science* 296:356-9, 2002). Briefly, mice are inoculated (30 μl/mouse) intracerebrally for each virus dilution (in 10-fold increments). Intranasal infection can be performed using the method of Nagata et al. (*Virology* 321:87-100, 2004), as transgenic mice are susceptible to polio infection via the intranasal route.

Analysis of Challenge/Protection

After the neurovirulence properties of the codon-deoptimized viruses are determined, challenge studies can be used to demonstrate that the codon-deoptimized viruses protect mice from disease. Briefly, mice are inoculated with a codon-deoptimized virus using conditions that induce neutralizing antibody. Immunized mice are challenged 21 days later with neurovirulent type 2 MEF1 virus at paralytic doses. The absence of paralytic signs when challenged with neurovirulent prototype MEF1 indicates that the transgenic PVR-Tg21 mice are protected by their prior exposure to codon-deoptimized MEF1 virus. The type-specificity of protection is measured by challenge with the neurovirulent type 1 poliovirus, Mahoney and neurovirulent type 3 poliovirus.

Monkey Neurovirulence

As an alternative to using mice, the ability of a deoptimized poliovirus to be used as an immunogen can be determined in rhesus monkeys. Deoptimized polioviruses, such as those disclosed herein, can be administered to monkeys and neurovirulence assayed. Examples of deoptimized viruses include, but are not limited to sequences that include SEQ ID NOS: 5, 8, 58, or 65-70). Briefly, intraspinal inoculation of rhesus monkeys will be performed according to the recommendations of the World Health Organization for Type 2 OPV (WHO Tech. Rep. Ser. 800, 30-65, 1990). Requirements for poliomyelitis vaccine (oral), and the United States Code of Federal Regulations, Title 21, Part 630.16 (1994). For example, 10-14 juvenile rhesus monkeys will be inoculated in the lumbar region of the spinal cord with 0.1-0.2 ml of virus (6-7 $\log_{10}$ $CCID_{50}$/monkey). The ability of the deoptimized virus to stimulate an immune response in the treated monkeys can be determined as described above.

Example 26

Methods of Determining Replicative Fitness

This example describes methods that can be used to measure the replicative fitness of a virus or bacteria. One skilled in the art will appreciate that other methods can also be used.

In one example, the replicative fitness of a deoptimized virus is determined by calculation of plaque size and number. Briefly, RNA transcripts of viral sequences having a deoptimized sequence or a native sequence are transfected into the appropriate cell line. The resulting virus obtained from the primary transfection can be passaged again to increase virus titers. The virus is then used to infect cells (such as confluent HeLa cell monolayers), and incubated at room temperature for 10-60 minutes, such as 30 minutes, prior to the addition of 0.45% SeaKem LE Agarose (Bio-Whittaker Molecular, Rockland, Me.) in culture medium. Plates are incubated for 50-100 hours at 35° C. (or at a temperature most appropriate for the virus strain under study), fixed with 0.4% formaldehyde and stained with 3% crystal violet. Plaque size is the quantified, for example by manual measurement and counting of the plaques, or by scanning plates (for example on a FOTO/Analyst Archiver system, Fotodyne, Hartland, Wis.) and subsequent image analysis (for example using Scion Image for Windows, Scion Corp., Frederick, Md.). A codon-deoptimized virus is considered to have reduced replicative fitness when the size or number of plaques is reduced by at least 50%, for example at least 75%, as compared to the size or number of plaques generated by the native virus.

The replicative fitness of a virus can also be determined using single-step growth experiments. Virus (deoptimized and native) is generated as described above. The appropriate cells (such as HeLa cells) are infected at a multiplicity of infection (MOI) of 1-10 PFU/cell with stirring for 10-60 minutes at 35° C. Cells are then sedimented by low-speed centrifugation and resuspended in culture media. Incubation continued at 35° C. in a water bath with orbital shaking at 300 rpm. Samples are withdrawn at 2-hour intervals from 0 to 14 hours postinfection, and titered by plaque assay as described above.

To determine the replicative fitness of a bacterium or yeast pathogen, a colony-forming assay can be performed. Briefly, bacterial or yeast suspensions can be plated onto agar plates containing solidified medium with the appropriate nutrients, and after incubation (normally at 37° C.), the number of colonies are counted. Alternatively, growth rates can be measured spectrophotometrically by following the increase in optical density of the appropriate liquid medium after inoculation with the bacterial or yeast cultures. Another method to measure growth rates would use quantitative PCR to determine the rate of increase of specific nucleic acid targets as the bacterial or yeast cells are incubated in the appropriate liquid medium.

In view of the many possible embodiments to which the principles of our invention may be applied, it should be recognized that the illustrated examples are only particular examples of the invention and should not be taken as a limitation on the scope of the invention. Rather, the scope of the invention is defined by the following claims. We therefore claim as our invention all that comes within the scope and spirit of these claims.

SEQUENCE LISTING (86 sequences)

SEQ ID NO: 1 - DNA, 67 bp, Artificial
  primer
cctaagcttttttttttttttttttttttttttttttccccgaattaaagaaaaatttacccctaca

SEQ ID NO: 2 - DNA, 48 bp, Artificial
  primer
gtagtcgactaatacgactcactataggttaaaacagctctggggttg

SEQ ID NO: 3 - DNA, 2745 bp, Human poliovirus 2
  CDS (109)..(2745)
gagtgttgtgtcaggtatacaactgtttgttggaaccactgtgttagctttacttctcatttaaccaattaatcaaaaacaatacgaggataaaacaacaatactacaatgggcgcccaagtttcatcacagaaagttggagcccacgaaaattcaaacagagcctatggcgggtccaccatcaattacactacaatcaattactatagggactctgcaagcaatgcagcaagcaagcaagattttgcacaagatccgtccaagttcaccgaacccattaaggacgtccttattaagaccgctcccatgctaaactccccaaacattgaggcgtgtggttatagtgacagggtaatgcagctaactctgggcaattcaacgatcaccacccaagaagcggccaattctgttgttgcctacggtagatggcctgaatacatcagagataccgaggcaaatcctgtagaccaaccaaccgagcccgatgtagccgcgtgcaggttctacacattagataccgtcacttggcgcaaggagtccagagggtggtggtggaaactaccagacgctttaaaagacatggggttatttggtcaaaacatgttttatcactatcttgggagggctggctacacagtgcacgtacagtgcaatgcttcaaagtttcatcaaggagctctaggggtgtttgcagttccagaaatgtgtttagctggtgatagcacaactcacatgttcacaaagtacgagaatgcgaatccaggcgaaaaaggaggtgaattcaaagggagtttcacccttgataccaacgccactaaccctgcacggaacttctgcccagttgattacctcttcgggagtggagtgctggtagggaatgcatttgtttatccacatcaaataataaacctgcgcactaacaactgtgctacgctagtattgccctatgtaaactcactctcaatagatagcatgacaaagcacaacaactgggggatcgctatcctccccctggcgccactagactttgccactgaatcttccactgagatacccattacactgaccattgctcccatgtgctgcgaattcaatggtttacgcaacatcactgtgccaagaacccaaggattaccagtcctgaacactccagggagtaaccagtacctgaccgcagacaattaccagtctccgtgtgcgatacctgagtttgatgtcactccacccatagacataccaggggaggtgcgcaacatgatggaattggcggaaatagacaccatgatacccctcaacttgacaagtcaacgcaagaacacaatggacatgtatagagtcgagttgagcgacacggctcactctgacacgccgatcttgtgtctctcgttgtcccccgcttcagaccccagattggcacacactatgttgggtgagatattaaattactacacacactgggcagggtccttgaaatttacctttctcttttgcggctcaatgatggccaccggaaagttattggtttcttacgcaccacccggagcagaggcccccaagagtcgcaaagaagcaatgcttgggacacatgtgatatgggacattgggttgcagtcttcatgcactatggtggtaccttggatcagtaataccacatacagacaaaccatcaacgatagtttcacagaaggtggctacattagcatgttctatcaaactagggttgttgtcccgttgtccacacccagaaagatggacatcctgggttttgtgtcagcttgcaatgacttcagtgtgcgcttactgcgagatacaacacacattagtcaagaggctatgccacaaggaattggtgacatgattgagggggccgttgaagggattactaaaaatgcattggttcccccgacttccaccaatagcctgcctgacacaaagccgagcggtccagcccactccaaggagatacctgcattgacagccgtggagacaggggctaccaatccgttggtgccttcggacaccgtgcaaacgcgccatgtcatccagagacgaacgcgatcagagtccacggttgagtcattctttgcaagaggggcttgcgtggctatcattgaggtggacaatgatgcaccgacaaagcgcgccagcagattgttttcggtttggaaaataacttacaaagatactgttcaactgagacgcaaactggaatttttcacatattcgagatttgacatggagttcacttttgtggtcacctcaaactacattgatgcaaataacggacatgcattgaaccaagtttatcagataatgtatataccacccggagcacctatccctggtaaatggaatgactatacgtggcagacgtcctctaacccgtcggtgttttacacctatggggcgcccccagcaagaatatcagtgccctacgtgggaattgctaatgcgtattcccacttttatgatgggtttgcaaaagtaccactagcgggtcaagcctcaactgaaggcgattcgttgtacggtgctgcctcactgaatgattttggatcactggctgttcgcgtggtaaatgatcacaaccccacgcggctcacctccaagatcagagtgtacatgaagccaaagcatgtcagagtctggtgcccacgacctccacgagcagtcccatacttcggaccaggtgttgattataaagatgggctcaccccactaccagaaaagggattaacgacttat

SEQ ID NO: 4 - protein, 879 aa, Human poliovirus 2
MGAQVSSQKVGAHENSNRAYGGSTINYTTINYYRDSASNAASKQDFAQDPSKFTEPIKDVLIKTAPMLNSPNIEACGYSDRVMQLTLGNSTITTQEAANSVVAYGRWPEYIRDTEANPVDQPTEPDVAACRFYTLDTVTWRKESRGWWWKLPDALKDMGLFGQNMFYHYLGRAGYTVHVQCNASKFHQGALGVFAVPEMCLAGDSTTHMFTKYENANPGEKGGEFKGSFTLDTNATNPARNFCPVDYLFGSGVLVGNAFVYPHQIINLRTNNCATLVLPYVNSLSIDSMTKHNNWGIAILPLAPLDFATESSTEIPITLTIAPMCCEFNGLRNITVPRTQGLPVLNTPGSNQYLTADNYQSPCAIPEFDVTPPIDIPGEVRNMMELAEIDTMIPLNLTSQRKNTMDMYRVELSDTAHSDTPILCLSLSPASDPRLAHTMLGEILNYYTHWAGSLKFTFLFCGSMMATGKLLVSYAPPGAEAPKSRKEAMLGTHVIWDIGLQSSCTMVVPWISNTTYRQTINDSFTEGGYISMFYQTRVVVPLSTPRKMDILGFVSACNDFSVRLLRDTTHISQEAMPQGIGDMIEGAVEGITKNALVPPTSTNSLPDTKPSGPAHSKEIPALTAVETGATNPLVPSDTVQTRHVIQRRTRSESTVESFFARGACVAIIEVDNDAPTKRASRLFSVWKITYKDTVQLRRKLEFFTYSRFDMEFTFVVTSNYIDANNGHALNQVYQIMYIPPGAPIPGKWNDYTWQTSSNPSVFYTYGAPPARISVPYVGIANAYSHFYDGFAKVPLAGQASTEGDSLYGAASLNDFGSLAVRVVNDHNPTRLTSKIRVYMKPKHVRVWCPRPPRAVPYFGPGVDYKDGLTPLPEKGLTTY

SEQ ID NO: 5 - DNA, 2745 bp, Artificial
  deoptimized Sabin 2 sequence
gagtgttgtgtcaggtatacaactgtttgttggaaccactgtgttagctttacttctcatttaaccaattaatcaaaaacaatacgaggataaaacaacaatactacaatgggtgcgcaagtcagcagccagaaagtcggtgcgcacgaaaatagcaaccgggcgtatggtggtagcacgatcaattacacgacgatcaattactatcgggacagcgcgagcaatgcggcgagcaagcaagattttgcgcaagatccgagcaagttcacggaaccgatcaaggacgtccttatcaagacggcgccgatgcttaacagcccgaacatcgaggcgtgtggttatagtgaccgggtcatgcagcttacgcttggtaatagcacgatcacgacgcaagaagcggcgaatagcgtcgtcgcgtacggtcggtggccggaatacatccgggatacggaggcgaatccggtcgaccaaccgacggagccggatgtcgcggcgtgccggttctacacgcttgatacggtcacgtggcggaaggagagccggggttggtggtggaaacttccggacgcgcttaaagacatgggtctttttggtcaaaacatgttttatcactatcttggtcgggcgggttacacggtccacgtccagtgcaatgcgagcaagtttcatcaaggtgcccttggtgtctttgcggtcccggaaatgtgtcttgcgggtgatagcacgacgcacatgttcacgaagtacgagaatgcgaatccgggtgaaaaaggtggtgaattcaaaggtagcttcacgcttgatacgaacgcgacgaacccggcgcggaacttctgcccggtcgattaccttttcggtagcggtgtccttgtcggtaatgcgtttgtctatccgcatcaaatcatcaaccttcggacgaacaactgtgcgacgcttgtcttgccgtatgtcaacagcctyagcatcgatagcatgacgaagcacaacaactggggtatcgcgatccttccgcttgcgccgcttgactttgcgacggaaagcagcacggagatcccgatcacgcttacgatcgcgccgatgtgctgcgaattcaatggtcttcggaacatcacggtcccgcggacgcaaggtcttccggtccttaacacgccgggtagcaaccagtaccttacggcggacaattaccagagcccgtgtgcgatcccggagtttgatgtcacgccgccgatcgacatcccgggtgaggtccggaacatgatggaacttgcggaaatcgacacgatgatcccgcttaaccttacgagccaacggaagaacacgatggacatgtatcgggtcgagcttagcgacacggcgcacagcgacacgccgatcctttgtcttagcttgagcccggcgagcgacccgcggcttgcgcacacgatgcttggtgagatccttaattactacacgcactgggcgggtagcttgaaatttacgtttcttttttgcggtagcatgatggcgacgggtaagcttcttgtcagctacgcgccgccgggtgcggaggcgccgaagagccggaaagaagcgatgcttggtacgcatgtcatctgggacatcggtcttcagagcagctgcacgatggtcgtcccgtggatcagcaatacgacgtaccggcaaacgatcaacgatagcttcacggaaggtggttacatcagcatgttctatcaaacgcgggtcgtcgtcccgcttagcacgccgcggaagatggacatccttggttttgtcagcgcgtgcaatgacttcagcgtccggcttcttcgggatacgacgcacatcagccaagaggcgatgccgcaaggtatcggtgacatgatcgagggtgcggtcgaaggtatcacgaaaaatgcgcttgtcccgccgacgagcacgaatagccttccggacacgaagccgagcggtccggcgcacagcaaggagatcccggcgcttacggcggtcgagacgggtgcgacgaatccgcttgtcccgagcgacacggtccaaacgcggcatgtcatccagcggcggacgcggagcgagagcacggtcgagagcttctttgcgcggggtgcgtgcgtcgcgatcatcgaggtcgacaatgatgcgccgacgaagcgggcgagccggctttttagcgtctggaaaatcacgtacaaagatacggtccaacttcggcggaaacttgaatttttcacgtatagccggtttgacatggagttcacgtttgtcgtcacgagcaactacatcgatgcgaataacggtcatgcgcttaaccaagtctatcagatcatgtatatcccgccgggtgcgccgatcccgggtaaatggaatgactatacgtggcagacgagcagcaacccgagcgtcttttacacgtatggtgcgccgccggcgcggatcagcgtcccgtacgtcggtatcgcgaatgcgtatagccacttttatgatggttttgcgaaagtcccgcttgcgggtcaagcgagcacggaaggtgatagcctttacggtgcggcgagccttaatgattttggtagccttgcggtccgggtcgtcaatgatcacaacccgacgcggcttacgagcaagatccgggtctacatgaagccgaagcatgtccgggtctggtgcccgcggcctcctcgagcggtcccgtacttcggtccgggtgtcgattataaagatgggctcaccccactaccagaaaagggattaacgacttat

SEQ ID NO: 6 - DNA, 6621 bp, Human poliovirus 2
  CDS (1)..(6621)
atgggcgcccaagtctcatcacagaaagttggagcccatgagaattcaaacagagcttatggcggatccaccattaattacactactattaattattacagggattctgcgagcaatgccgctagtaagcaggactttgcacaagacccatccaagttcactgaacctattaaagatgttctcattaagaccgctcccacgctaaactctcctaatatcgaggcgtgtgggtatagcgacagagtgatgcaactaaccctaggcaattccaccattaccacacaggaggcggccaattctgtcgttgcatacggccggtggcccgagtacatcaaggactcagaagcaaatcctgtggaccagccaactgaaccggacgttgccgcgtgcaggttttacacactagacactgttacttggcgcaaggagtccagagggtggtggtggaaactgcctgatgcactaaaggacatgggattattcggccagaacatgttctaccactacctcgggagggctggctatactgtgcacgtacagtgtaatgcttcaaagtttcaccagggcgccctcggggtattcgcagttccagaaatgtgcctggcaggcgacagcacaacccacatgtttacaaaatatgagaatgcaaatccgggtgagaaagggggtgaattcaaagggagttttactctggatactaacgctaccaaccctgcacgcaacttttgtcccgttgattatctcttcgggagcggagtactggcgggaaatgcgtttgtttacccacatcagataattaatctgcgcaccaacaactgtgccacgttggtgctgccatacgttaattcactttccatagacagcatgacaaaacacaacaattggggaattgctatccttccgctggcaccacttgactttgccaccgagtcctccactgagatacccattactctaactattgcccctatgtgttgtgaattcaatgggttgcgcaacatcactgtacccagaactcaagggttgccagtcttaaacactccaggaagcaaccagtacttaacagcagacaactatcaatccccatgtgcgatacccgagtttgatgtaacaccacccatagacatcccgggggaagtgcgcaacatgatggaattggcagagatagacaccatgatacctctcaatctgacgaaccagcgcaagaacaccatggatatgtacagagtcgaactgaatgatgcggctcactctgacacaccaatattgtgtctctcactgtctccagcatcagatcctaggctagcacacactatgctaggtgaaatactgaactactacacacactgggcagggtcattgaagttcacatttctcttctgcggctcaatgatggccactggtaaattgctagtgtcctatgcacctcctggtgcggaagcccctaaaagccgcaaagaagcgatgctcggcacccacgtgatctgggacatcggattacagtcatcatgcactatggtggtaccttggattagcaacaccacatacagacaaaccatcaacgatagcttcacagaaggagggtacatcagtatgttttaccaaactagagttgttgtgccattgtccacccctagaaagatggacatattgggctttgtgtcagcctgcaatgacttcagtgtgcgcctgttgcgtgacacgacgcacataagccaagaggctatgccacaaggattgggtgatttaattgaaggggttgttgagggagtcacgagaaatgccttgacaccactgacacctgccaacaacttgcctgatacacaatctagcggcccagcccactctaaggaaacaccagcgctaacagccgtagagacaggggccaccaacccattggtgccttcagacacggtacaaactcgtcacgtcatccaaaagcggacgcggtcggagtctacggttgagtctttcttcgcaagaggagcttgtgtggccattattgaagtggataatgatgctccaacaaagcgtgccagtaaattattttcagtctggaagataacttacaaagacaccgttcagttaagacgtaagttggagttctttacatattcaaggtttgacatggagttcacctttgtggttacatccaattataccgatgcaaacaatgggcacgcactaaatcaagtttaccagataatgtacataccacctggggcaccgatccctggcaagtggaatgattacacatggcaaacgtcatctaacccatcagtgttttacacttacggggcacctccagctagaatatcagtgccctacgtgggcattgccaatgcatattctcatttttacgatgggtttgccaaagtaccactagcaggccaagcctcaacagagggtgactcgctgtatggagcggcttcattgaatgacttcggatcactggctgttcgagtggtgaatgaccacaaccctacgaaactcacttcaaaaatcagagtgtacatgaaaccaaagcacgtcagagtgtggtgtccgcgaccccctcgagcagtcccatactacggaccaggggttgactacaaggatggactagccccactgccagagaaaggcttgacaacctatggttttggccaccaaaataaggcagtgtacacggcaggttacaaaatttgcaattaccacctcgccacccaggaagacttacaaaatgcggtaaacattatgtggattagagaccttttagtagtggaatccaaagcccaaggcatagactcaattgctagatgtaactgccacactggagtgtactactgtgaatccaggaggaagtactacccggtctcttttactggccccacctttcagtacatggaagcaaatgagtactatccagcccgataccaatcccacatgttaattggccatggttttgcatctccaggggactgtggtgggattctcaggtgccaacatggagtaattggaatcattacagctggaggagaaggcctagtcgctttctcggacatcagagatctgtacgcatacgaggaggaggctatggagcagggagtctccaactatattgagtcccttggggctgcatttgggagtggattcacccagcaaataggaaacaaaatttcagaactcactagcatggtcaccagcactataactgagaaactactaaagaatctcattaaaataatttcatcccttgttatcatcaccagaaactatgaagacacgaccacagtgctggctacccttgctctcctcggttgtgatgcgtccccatggcaatggctaaagaagaaagcctgtgacatcttggaaatcccctacatcatgcgacagggcgatagctggttgaagaagtttacagaggcatgcaatgcagccaagggattggaatgggtgtctaataaaatatccaaatttattgactggctcaaagagaagatcattccacaggctagagacaagctagagtttgttaccaaactgaagcaactagaaatgttggagaaccaaattgcaaccattcatcaatcgtgcccaagtcaggagcatcaagaaatcctgttcaataacgtgagatggttatccatacagtcaaagagatttgccccgctctatgcggttgaggctaagagaatacaaaagttagagcacacgattaacaactacgtacagttcaagagcaaacaccgtattgaaccagtatgtttgttggtgcacggtagcccaggcacgggcaagtcagttgccaccaatttaattgccagagcaatagcagagaaggagaacacctccacatactcactaccaccagatccctcccatttcgatgggtacaagcaacaaggtgtggtgatcatggatgatttgaatcagaacccagacggagcagacatgaagctgttttgtcagatggtctccactgtagaattcataccaccaatggcttcgctagaagaaaagggtattttgttcacatctaattacgttttggcctcaaccaattccagtcgcatcaccccaccaactgttgcgcacagcgatgccctagccaggcgctttgcatttgacatggacatacaaatcatgagcgagtattctagagatggaaaattgaacatggcgatggcaactgaaatgtgtaagaactgtcatcaaccagcaaacttcaagagatgttgcccattggtgtgtggcaaagccatccagctgatggacaaatcttccagagtcagatatagtatagatcagattactaccatgattattaatgagaggaacagaagatcaagtatcggtaattgcatggaggcacttttccaaggtcctcttcaatacaaagacctgaaaatagacattaagaccacacctcctcctgagtgcatcaatgatttgctccaagcagttgattctcaagaggtaagagactactgtgagaagaagggttggatagtagacatcactagtcaggtgcaaaccgaaagaaacatcaatagagcaatgactattcttcaggcggtcaccacatttgccgcagttgctggagtggtgtatgtgatgtacaaactctttgcagggcatcaaggagcgtatacagggcttcccaataagagacccaatgtccccaccatcaggactgccaaggttcagggcccaggatttgactacgcagtggcaatggccaaaagaaacattcttacggcaactaccattaagggagagttcacaatgctcggagtgcatgataatgtggccattctaccaacccacgcatcaccgggtgaaacaatagtcattgatggcaaggaagtagaggtactggatgctaaagccctggaggaccaggccgggaccaacctagaaatcaccattgtcactcttaagagaaatgagaagttcagggacatcagaccacacatccccactcaaatcactgagacaaatgatggagttttaattgtgaacactagtaagtaccccaacatgtatgttcctgtcggtgctgtgactgaacaggggtatctcaatctcggtggacgccaaactgctcgtactttaatgtacaactttccaacgagagcaggtcaatgtggtggagttatcacctgcactggcaaggtcatcgggatgcatgttggtgggaacggttcacatgggttcgcagcagccctgaagcgatcctatttcactcagagtcaaggtgaaatccagtggatgagaccatcaaaagaagtgggctaccccgttattaatgctccatctaaaactaaactggaacccagtgcattccattatgtgtttgaaggtgtcaaggaaccagctgtgctcaccaaaagtgaccccagattgaagacagattttgaagaggctatcttttccaagtatgtgggaaataagattactgaagtggatgagtacatgaaagaagctgtcgatcattacgcaggccagctcatgtcactagacatcaacacagaacaaatgtgccttgaggatgcaatgtatggcactgacggtctcgaagctctagacctcagtaccagtgctgggtatccctatgtggcaatggggaaaaagaaaagagacattttgaataagcaaaccagagacacaaaggaaatgcaaaggcttctggacacctatggtattaatttacctttagtcacctatgtgaaagatgagcttagatccaagaccaaagtggaacagggcaagtccaggctaattgaggcctcaagtctcaatgactctgtcgccatgaggatggcttttggcaacttgtacgcagcattccacaagaacccaggtgtagtgacaggatcggctgttggctgtgacccagatttgttttggagtaaaataccagtcctcatggaggaaaaactctttgcatttgattacacgggttatgatgcttcactaagccccgcctggtttgaggctctcaagatggttctagagaaaattgggtttggtgacagagtggattacattgattatctgaatcactcgcaccatctatataaaaataagacatattgtgttaagggcggcatgccatctggctgctctggcacctcaatttttaattcaatgattaataatctaataatcaggactctcttactgaaaacctacaagggcatagatttagaccacctgaagatgatagcctatggtgatgatgtaattgcttcctacccccatgaggttgatgctagtctcctagcccaatcaggaaaagactatggactaaccatgacaccagctgacaaatcagccacctttgaaacagtcacatgggagaatgtaacattcttgaaaagattctttagagcagatgaaaagtatccctttctggtacatccagtgatgccaatgaaagaaattcacgaatcaattagatggactaaagatcccagaaacactcaggatcatgttcgctcactgtgcttattggcttggcacaatggcgaggaagagtacaataaatttttagctaagattagaagtgtgccaatcggaagagcattactgctccctgagtactccacattgtaccgccgttggctcgactcattt

SEQ ID NO: 7 - protein, 2207 aa, Human poliovirus 2
MGAQVSSQKVGAHENSNRAYGGSTINYTTINYYRDSASNAASKQDFAQDPSKFTEPIKDVLIKTAPTLNSPNIEACGYSDRVMQLTLGNSTITTQEAANSVVAYGRWPEYIKDSEANPVDQPTEPDVAACRFYTLDTVTWRKESRGWWWKLPDALKDMGLFGQNMFYHYLGRAGYTVHVQCNASKFHQGALGVFAVPEMCLAGDSTTHMFTKYENANPGEKGGEFKGSFTLDTNATNPARNFCPVDYLFGSGVLAGNAFVYPHQIINLRTNNCATLVLPYVNSLSIDSMTKHNNWGIAILPLAPLDFATESSTEIPITLTIAPMCCEFNGLRNITVPRTQGLPVLNTPGSNQYLTADNYQSPCAIPEFDVTPPIDIPGEVRNMMELAEIDTMIPLNLTNQRKNTMDMYRVELNDAAHSDTPILCLSLSPASDPRLAHTMLGEILNYYTHWAGSLKFTFLFCGSMMATGKLLVSYAPPGAEAPKSRKEAMLGTHVIWDIGLQSSCTMVVPWISNTTYRQTINDSFTEGGYISMFYQTRVVVPLSTPRKMDILGFVSACNDFSVRLLRDTTHISQEAMPQGLGDLIEGVVEGVTRNALTPLTPANNLPDTQSSGPAHSKETPALTAVETGATNPLVPSDTVQTRHVIQKRTRSESTVESFFARGACVAIIEVDNDAPTKRASKLFSVWKITYKDTVQLRRKLEFFTYSRFDMEFTFVVTSNYTDANNGHALNQVYQIMYIPPGAPIPGKWNDYTWQTSSNPSVFYTYGAPPARISVPYVGIANAYSHFYDGFAKVPLAGQASTEGDSLYGAASLNDFGSLAVRVVNDHNPTKLTSKIRVYMKPKHVRVWCPRPPRAVPYYGPGVDYKDGLAPLPEKGLTTYGFGHQNKAVYTAGYKICNYHLATQEDLQNAVNIMWIRDLLVVESKAQGIDSIARCNCHTGVYYCESRRKYYPVSFTGPTFQYMEANEYYPARYQSHMLIGHGFASPGDCGGILRCQHGVIGIITAGGEGLVAFSDIRDLYAYEEEAMEQGVSNYIESLGAAFGSGFTQQIGNKISELTSMVTSTITEKLLKNLIKIISSLVIITRNYEDTTTVLATLALLGCDASPWQWLKKKACDILEIPYIMRQGDSWLKKFTEACNAAKGLEWVSNKISKFIDWLKEKIIPQARDKLEFVTKLKQLEMLENQIATIHQSCPSQEHQEILFNNVRWLSIQSKRFAPLYAVEAKRIQKLEHTINNYVQFKSKHRIEPVCLLVHGSPGTGKSVATNLIARAIAEKENTSTYSLPPDPSHFDGYKQQGVVIMDDLNQNPDGADMKLFCQMVSTVEFIPPMASLEEKGILFTSNYVLASTNSSRITPPTVAHSDALARRFAFDMDIQIMSEYSRDGKLNMAMATEMCKNCHQPANFKRCCPLVCGKAIQLMDKSSRVRYSIDQITTMIINERNRRSSIGNCMEALFQGPLQYKDLKIDIKTTPPPECINDLLQAVDSQEVRDYCEKKGWIVDITSQVQTERNINRAMTILQAVTTFAAVAGVVYVMYKLFAGHQGAYTGLPNKRPNVPTIRTAKVQGPGFDYAVAMAKRNILTATTIKGEFTMLGVHDNVAILPTHASPGETIVIDGKEVEVLDAKALEDQAGTNLEITIVTLKRNEKFRDIRPHIPTQITETNDGVLIVNTSKYPNMYVPVGAVTEQGYLNLGGRQTARTLMYNFPTRAGQCGGVITCTGKVIGMHVGGNGSHGFAAALKRSYFTQSQGEIQWMRPSKEVGYPVINAPSKTKLEPSAFHYVFEGVKEPAVLTKSDPRLKTDFEEAIFSKYVGNKITEVDEYMKEAVDHYAGQLMSLDINTEQMCLEDAMYGTDGLEALDLSTSAGYPYVAMGKKKRDILNKQTRDTKEMQRLLDTYGINLPLVTYVKDELRSKTKVEQGKSRLIEASSLNDSVAMRMAFGNLYAAFHKNPGVVTGSAVGCDPDLFWSKIPVLMEEKLFAFDYTGYDASLSPAWFEALKMVLEKIGFGDRVDYIDYLNHSHHLYKNKTYCVKGGMPSGCSGTSIFNSMINNLIIRTLLLKTYKGIDLDHLKMIAYGDDVIASYPHEVDASLLAQSGKDYGLTMTPADKSATFETVTWENVTFLKRFFRADEKYPFLVHPVMPMKEIHESIRWTKDPRNTQDHVRSLCLLAWHNGEEEYNKFLAKIRSVPIGRALLLPEYSTLYRRWLDSF

SEQ ID NO: 8 - DNA, 6621 bp, Artificial
  deoptimized MEF1 sequence
atgggcgcccaagtctcatcacagaaagttggagcccatgagaattcaaaccgggcttatggcggatccaccattaattacactactattaattattaccgggattctgcgagcaatgccgctagtaagcaggactttgcacaagacccatccaagttcactgaacctattaaagatgttctcattaagaccgctcccacgctaaactctcctaatatcgaggcgtgtgggtatagcgaccgggtgatgcaactaaccctaggcaattccaccattaccacacaggaggcggccaattctgtcgttgcatacggccggtggcccgagtacatcaaggactcagaagcaaatcctgtggaccagccaactgaaccggacgttgccgcgtgccggttttacacactagacactgttacttggcggaaggagtcccgggggtggtggtggaaactgcctgatgcactaaaggacatgggattattcggccagaacatgttctaccactacctcgggcgggctggctatactgtgcacgtacagtgtaatgcttcaaagtttcaccagggcgccctcggggtattcgcagttccagaaatgtgcctggcaggcgacagcacaacccacatgtttacaaaatatgagaatgcaaatccgggtgagaaagggggtgaattcaaagggagttttactctggatactaacgctaccaaccctgcacggaacttttgtcccgttgattatctcttcgggagcggagtactggcgggaaatgcgtttgtttacccacatcagataattaatctgcggaccaacaactgtgccacgttggtgctgccatacgttaattcactttccatagacagcatgacaaaacacaacaattggggaattgctatccttccgctggcaccacttgactttgccaccgagtcctccactgagatacccattactctaactattgcccctatgtgttgtgaattcaatgggttgcggaacatcactgtaccccggactcaagggttgccagtcttaaacactccaggaagcaaccagtacttaacagcagacaactatcaatccccatgtgcgatacccgagtttgatgtaacaccacccatagacatcccgggggaagtgcggaacatgatggaattggcagagatagacaccatgatacctctcaatctgacgaaccagcggaagaacaccatggatatgtaccgggtcgaactgaatgatgcggctcactctgacacaccaatattgtgtctctcactgtctccagcatcagatcctcggctagcacacactatgctaggtgaaatactgaactactacacacactgggcagggtcattgaagttcacatttctcttctgcggctcaatgatggccactggtaaattgctagtgtcctatgcacctcctggtgcggaagcccctaaaagccggaaagaagcgatgctcggcacccacgtgatctgggacatcggattacagtcatcatgcactatggtggtaccttggattagcaacaccacataccggcaaaccatcaacgatagcttcacagaaggagggtacatcagtatgttttaccaaactcgggttgttgtgccattgtccacccctcggaagatggacatattgggctttgtgtcagcctgcaatgacttcagtgtgcggctgttgcgggacacgacgcacataagccaagaggctatgccacaaggattgggtgatttaattgaaggggttgttgagggagtcacgcggaatgccttgacaccactgacacctgccaacaacttgcctgatacacaatctagcggcccagcccactctaaggaaacaccagcgctaacagccgtagagacaggggccaccaacccattggtgccttcagacacggtacaaactcggcacgtcatccaaaagcggacgcggtcggagtctacggttgagtctttcttcgcacggggagcttgtgtggccattattgaagtggataatgatgctccaacaaagcgggccagtaaattattttcagtctggaagataacttacaaagacaccgttcagttacggcggaagttggagttctttacatattcacggtttgacatggagttcacctttgtggttacatccaattataccgatgcaaacaatgggcacgcactaaatcaagtttaccagataatgtacataccacctggggcaccgatccctggcaagtggaatgattacacatggcaaacgtcatctaacccatcagtgttttacacttacggggcacctccagctcggatatcagtgccctacgtgggcattgccaatgcatattctcatttttacgatgggtttgccaaagtaccactagcaggccaagcctcaacagagggtgactcgctgtatggagcggcttcattgaatgacttcggatcactggctgttcgggtggtgaatgaccacaaccctacgaaactcacttcaaaaatccgggtgtacatgaaaccaaagcacgtccgggtgtggtgtccgcggccccctcgggcagtcccatactacggaccaggggttgactacaaggatggactagccccactgccagagaaaggcttgacaacctatggttttggccaccaaaataaggcagtgtacacggcaggttacaaaatttgcaattaccacctcgccacccaggaagacttacaaaatgcggtaaacattatgtggattcgggaccttttagtagtggaatccaaagcccaaggcatagactcaattgctcggtgtaactgccacactggagtgtactactgtgaatcccggcggaagtactacccggtctcttttactggccccacctttcagtacatggaagcaaatgagtactatccagcccggtaccaatcccacatgttaattggccatggttttgcatctccaggggactgtggtgggattctccggtgccaacatggagtaattggaatcattacagctggaggagaaggcctagtcgctttctcggacatccgggatctgtacgcatacgaggaggaggctatggagcagggagtctccaactatattgagtcccttggggctgcatttgggagtggattcacccagcaaataggaaacaaaatttcagaactcactagcatggtcaccagcactataactgagaaactactaaagaatctcattaaaataatttcatcccttgttatcatcacccggaactatgaagacacgaccacagtgctggctacccttgctctcctcggttgtgatgcgtccccatggcaatggctaaagaagaaagcctgtgacatcttggaaatcccctacatcatgcggcagggcgatagctggttgaagaagtttacagaggcatgcaatgcagccaagggattggaatgggtgtctaataaaatatccaaatttattgactggctcaaagagaagatcattccacaggctcgggacaagctagagtttgttaccaaactgaagcaactagaaatgttggagaaccaaattgcaaccattcatcaatcgtgcccaagtcaggagcatcaagaaatcctgttcaataacgtgcggtggttatccatacagtcaaagcggtttgccccgctctatgcggttgaggctaagcggatacaaaagttagagcacacgattaacaactacgtacagttcaagagcaaacaccggattgaaccagtatgtttgttggtgcacggtagcccaggcacgggcaagtcagttgccaccaatttaattgcccgggcaatagcagagaaggagaacacctccacatactcactaccaccagatccctcccatttcgatgggtacaagcaacaaggtgtggtgatcatggatgatttgaatcagaacccagacggagcagacatgaagctgttttgtcagatggtctccactgtagaattcataccaccaatggcttcgctagaagaaaagggtattttgttcacatctaattacgttttggcctcaaccaattccagtcggatcaccccaccaactgttgcgcacagcgatgccctagcccggcggtttgcatttgacatggacatacaaatcatgagcgagtattctcgggatggaaaattgaacatggcgatggcaactgaaatgtgtaagaactgtcatcaaccagcaaacttcaagcggtgttgcccattggtgtgtggcaaagccatccagctgatggacaaatcttcccgggtccggtatagtatagatcagattactaccatgattattaatgagcggaaccggcggtcaagtatcggtaattgcatggaggcacttttccaaggtcctcttcaatacaaagacctgaaaatagacattaagaccacacctcctcctgagtgcatcaatgatttgctccaagcagttgattctcaagaggtacgggactactgtgagaagaagggttggatagtagacatcactagtcaggtgcaaaccgaacggaacatcaatcgggcaatgactattcttcaggcggtcaccacatttgccgcagttgctggagtggtgtatgtgatgtacaaactctttgcagggcatcaaggagcgtatacagggcttcccaataagcggcccaatgtccccaccatccggactgccaaggttcagggcccaggatttgactacgcagtggcaatggccaaacggaacattcttacggcaactaccattaagggagagttcacaatgctcggagtgcatgataatgtggccattctaccaacccacgcatcaccgggtgaaacaatagtcattgatggcaaggaagtagaggtactggatgctaaagccctggaggaccaggccgggaccaacctagaaatcaccattgtcactcttaagcggaatgagaagttccgggacatccggccacacatccccactcaaatcactgagacaaatgatggagttttaattgtgaacactagtaagtaccccaacatgtatgttcctgtcggtgctgtgactgaacaggggtatctcaatctcggtggacggcaaactgctcggactttaatgtacaactttccaacgcgggcaggtcaatgtggtggagttatcacctgcactggcaaggtcatcgggatgcatgttggtgggaacggttcacatgggttcgcagcagccctgaagcggtcctatttcactcagagtcaaggtgaaatccagtggatgcggccatcaaaagaagtgggctaccccgttattaatgctccatctaaaactaaactggaacccagtgcattccattatgtgtttgaaggtgtcaaggaaccagctgtgctcaccaaaagtgacccccggttgaagacagattttgaagaggctatcttttccaagtatgtgggaaataagattactgaagtggatgagtacatgaaagaagctgtcgatcattacgcaggccagctcatgtcactagacatcaacacagaacaaatgtgccttgaggatgcaatgtatggcactgacggtctcgaagctctagacctcagtaccagtgctgggtatccctatgtggcaatggggaaaaagaaacgggacattttgaataagcaaacccgggacacaaaggaaatgcaacggcttctggacacctatggtattaatttacctttagtcacctatgtgaaagatgagcttcggtccaagaccaaagtggaacagggcaagtcccggctaattgaggcctcaagtctcaatgactctgtcgccatgcggatggcttttggcaacttgtacgcagcattccacaagaacccaggtgtagtgacaggatcggctgttggctgtgacccagatttgttttggagtaaaataccagtcctcatggaggaaaaactctttgcatttgattacacgggttatgatgcttcactaagccccgcctggtttgaggctctcaagatggttctagagaaaattgggtttggtgaccgggtggattacattgattatctgaatcactcgcaccatctatataaaaataagacatattgtgttaagggcggcatgccatctggctgctctggcacctcaatttttaattcaatgattaataatctaataatccggactctcttactgaaaacctacaagggcatagatttagaccacctgaagatgatagcctatggtgatgatgtaattgcttcctacccccatgaggttgatgctagtctcctagcccaatcaggaaaagactatggactaaccatgacaccagctgacaaatcagccacctttgaaacagtcacatgggagaatgtaacattcttgaaacggttctttcgggcagatgaaaagtatccctttctggtacatccagtgatgccaatgaaagaaattcacgaatcaattcggtggactaaagatccccggaacactcaggatcatgttcggtcactgtgcttattggcttggcacaatggcgaggaagagtacaataaatttttagctaagattcggagtgtgccaatcggacgggcattactgctccctgagtactccacattgtaccggcggtggctcgactcattt

SEQ ID NO: 9 - DNA, 2202 bp, Foot-and-mouth disease virus - type O
  CDS (1)..(2202)
ggcgccgggcaatccagcccggcgactgggtcacagaaccagtcaggcaacactggaagcattatcaacaattactacatgcagcagtaccagaactccatggacacgcagcttggtgacaacgctattagcggaggctccaacgaggggtccacggacaccacctccactcacacaaccaacactcagaacaatgactggttttcaaagctggccagttccgcttttagcggtcttttcggcgctcttcttgctgacaagaaaaccgaggagaccactcttctcgaggaccgcatcctcactacccgcaacggacacacgacctcgacaacccagtcgagcgttggagtcacttacgggtacgcaacagctgaggactttgtgagcggaccaaacacatctgggcttgagaccagggttgtgcaggcagagcggttcttcaaaacccacttgttcgactgggtcaccagtgacccgtttggacggtgctatctgctggaactcccaactgaccacaaaggtgtctacggcagcctgaccgactcttatgcttacatgagaaacggttgggatgttgaggtcaccgcagtgggaaatcagttcaacggaggatgtctgttggtggccatggtgccagaactttgctctattgacaagagagagctgtaccagctcacgctctttccccaccagttcatcaacccccggacgaacatgacggcgcacatcactgtgccctttgttggcgtcaaccgctacgaccagtacaaggtacacaaaccttggaccctcgtggttatggttgtggccccgctgactgtcaacaccgaaggtgccccacagatcaaggtctatgccaacatcgcccctaccaacgtgcacgttgcgggtgagttcccttctaaggaagggatcttccccgtggcatgtagcgacggttacggtggtctggtgaccactgacccaaagacggctgaccccgcctacgggaaagtgttcaatccacctcgcaacatgttgccggggcggttcaccaacttccttgatgtggctgaggcgtgccctacgtttctgcactttgagggtggcgtgccgtacgtgaccacaaagacggactcagacagggtgctcgcccagttcgacttgtctctggcagcaaagcacatgtcaaacaccttcctggcaggtctcgcccagtactacacacagtacagcggcaccatcaacctgcacttcatgttcacaggacccactgacgcgaaagcgcgttacatgattgcatacgccccccctggtatggagccgcccaaaacacctgaggcggccgcccactgcattcatgcggagtgggacacagggttgaattcaaaattcacattttcaatcccttacctttcggcggctgattacgcgtacaccgcgtctgacgctgcggagaccacaaatgtacagggatgggtttgcctgtttcaaattacacacgggaaggctgacggcgacgcactggtcgttctagctagcgccggtaaggactttgagctgcgtctgccagttgacgctcgcacgcagaccacctccgcaggtgagtcggctgaccccgtgactgccactgttgagaactacggtggtgagacacaggtccagagacgccaacacacggatgtctcgttcatattagacagatttgtgaaagtaacaccaaaagaccaaattaatgtgttggacctgatgcaaacccctgcacacactttggtaggcgcgctcctccgtactgccacctactacttcgcagatctagaagtggcagtgaaacacgaggggaaccttacctgggtcccgaatggggcgcccgagacagcgttggacaacaccaccaatccaacggcttaccacaaggcaccgctcacccggcttgcactgccttacacggcaccgcaccgtgtcttggctactgtttacaacgggaactgcaagtatggcgagagccccgtgaccaatgtgagaggtgacctgcaagtattggcccaaaaggcggcaagaacgctgcctacctccttcaattacggtgccatcaaagccactcgggtgactgaactgctttaccgcatgaagagggccgaaacatactgcccccggcctcttttggctattcacccaagcgaagctagacacaaacaaaagattgttgcgcctgtgaaacag

SEQ ID NO: 10 - protein, 734 aa, Foot-and-mouth disease virus - type O
GAGQSSPATGSQNQSGNTGSIINNYYMQQYQNSMDTQLGDNAISGGSNEGSTDTTSTHTTNTQNNDWFSKLASSAFSGLFGALLADKKTEETTLLEDRILTTRNGHTTSTTQSSVGVTYGYATAEDFVSGPNTSGLETRVVQAERFFKTHLFDWVTSDPFGRCYLLELPTDHKGVYGSLTDSYAYMRNGWDVEVTAVGNQFNGGCLLVAMVPELCSIDKRELYQLTLFPHQFINPRTNMTAHITVPFVGVNRYDQYKVHKPWTLVVMVVAPLTVNTEGAPQIKVYANIAPTNVHVAGEFPSKEGIFPVACSDGYGGLVTTDPKTADPAYGKVFNPPRNMLPGRFTNFLDVAEACPTFLHFEGGVPYVTTKTDSDRVLAQFDLSLAAKHMSNTFLAGLAQYYTQYSGTINLHFMFTGPTDAKARYMIAYAPPGMEPPKTPEAAAHCIHAEWDTGLNSKFTFSIPYLSAADYAYTASDAAETTNVQGWVCLFQITHGKADGDALVVLASAGKDFELRLPVDARTQTTSAGESADPVTATVENYGGETQVQRRQHTDVSFILDRFVKVTPKDQINVLDLMQTPAHTLVGALLRTATYYFADLEVAVKHEGNLTWVPNGAPETALDNTTNPTAYHKAPLTRLALPYTAPHRVLATVYNGNCKYGESPVTNVRGDLQVLAQKAARTLPTSFNYGAIKATRVTELLYRMKRAETYCPRPLLAIHPSEARHKQKIVAPVKQ

SEQ ID NO: 11 - DNA, 2202 bp, Artificial
  deoptimized FMVD capsid sequence
ggggcggggcaatcgagcccggcgacggggtcgcagaaccagtcggggaacacggggagcataataaacaattactacatgcagcagtaccagaactcgatggacacgcagctaggggacaacgcgataagcggggggtcgaacgaggggtcgacggacacgacgtcgacgcacacgacgaacacgcagaacaatgactggttttcgaagctagcgtcgtcggcgtttagcgggctattcggggcgctactagcggacaagaaaacggaggagacgacgctactagaggaccgaatactaacgacgcgaaacgggcacacgacgtcgacgacgcagtcgagcgtaggggtaacgtacgggtacgcgacggcggaggactttgtaagcgggccgaacacgtcggggctagagacgcgagtagtacaggcggagcgattcttcaaaacgcacctattcgactgggtaacgtcggacccgtttgggcgatgctatctactagaactaccgacggaccacaaaggggtatacgggagcctaacggactcgtatgcgtacatgcgaaacgggtgggatgtagaggtaacggcggtagggaatcagttcaacggggggtgtctactagtagcgatggtaccggaactatgctcgatagacaagcgagagctataccagctaacgctatttccgcaccagttcataaacccgcgaacgaacatgacggcgcacataacggtaccgtttgtaggggtaaaccgatacgaccagtacaaggtacacaaaccgtggacgctagtagtaatggtagtagcgccgctaacggtaaacacggaaggggcgccgcagataaaggtatatgcgaacatagcgccgacgaacgtacacgtagcgggggagttcccgtcgaaggaagggatattcccggtagcgtgtagcgacgggtacggggggctagtaacgacggacccgaagacggcggacccggcgtacgggaaagtattcaatccgccgcgaaacatgctaccggggcgattcacgaacttcctagatgtagcggaggcgtgcccgacgtttctacactttgaggggggggtaccgtacgtaacgacgaagacggactcggaccgagtactagcgcagttcgacctatcgctagcggcgaagcacatgtcgaacacgttcctagcggggctagcgcagtactacacgcagtacagcgggacgataaacctacacttcatgttcacggggccgacggacgcgaaagcgcgatacatgatagcgtacgcgccgccggggatggagccgccgaaaacgccggaggcggcggcgcactgcatacatgcggagtgggacacggggctaaattcgaaattcacgttttcgataccgtacctatcggcggcggattacgcgtacacggcgtcggacgcggcggagacgacgaatgtacaggggtgggtatgcctatttcaaataacgcacgggaaggcggacggggacgcgctagtagtactagcgagcgcggggaaggactttgagctacgactaccggtagacgcgcgaacgcagacgacgtcggcgggggagtcggcggacccggtaacggcgacggtagagaactacgggggggagacgcaggtacagcgacgacaacacacggatgtatcgttcatactagaccgatttgtaaaagtaacgccgaaagaccaaataaatgtactagacctaatgcaaacgccggcgcacacgctagtaggggcgctactacgaacggcgacgtactacttcgcggatctagaagtagcggtaaaacacgaggggaacctaacgtgggtaccgaatggggcgccggagacggcgctagacaacacgacgaatccgacggcgtaccacaaggcgccgctaacgcgactagcgctaccgtacacggcgccgcaccgagtactagcgacggtatacaacgggaactgcaagtatggggagagcccggtaacgaatgtacgaggggacctacaagtactagcgcaaaaggcggcgcgaacgctaccgacgtcgttcaattacggggcgataaaagcgacgcgagtaacggaactactataccgaatgaagcgagcggaaacgtactgcccgcgaccgctactagcgatacacccgagcgaagcgcgacacaaacaaaagatagtagcgccggtaaaacag

SEQ ID NO: 12 - DNA, 3768 bp, SARS coronavirus Urbani
  CDS (1)..(3768)
atgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagctcgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataa

SEQ ID NO: 13 - protein, 1255 aa, SARS coronavirus Urbani
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 14 - DNA, 3768 bp, Artificial
  deoptimized SARS spike glycoprotein nucleic acid sequence
atgtttatcttcctgctgtttctgacgctgacgtcggggtcggacctggaccggtgcacgacgtttgatgatgtccaagcgccgaattacacgcaacatacgtcgtcgatgcggggggtctactatccggatgaaatctttcggtcggacacgctgtatctgacgcaggatctgtttctgccgttttattcgaatgtcacggggtttcatacgatcaatcatacgtttgggaacccggtcatcccgtttaaggatgggatctattttgcggcgacggagaaatcgaatgtcgtccgggggtgggtctttgggtcgacgatgaacaacaagtcgcagtcggtcatcatcatcaacaattcgacgaatgtcgtcatccgggcgtgtaactttgaactgtgtgacaacccgttctttgcggtctcgaaaccgatggggacgcagacgcatacgatgatcttcgataatgcgtttaattgcacgttcgagtacatctcggatgcgttttcgctggatgtctcggaaaagtcggggaattttaaacacctgcgggagtttgtctttaaaaataaagatgggtttctgtatgtctataaggggtatcaaccgatcgatgtcgtccgggatctgccgtcggggtttaacacgctgaaaccgatctttaagctgccgctggggatcaacatcacgaattttcgggcgatcctgacggcgttttcgccggcgcaagacatctgggggacgtcggcggcggcgtattttgtcgggtatctgaagccgacgacgtttatgctgaagtatgatgaaaatgggacgatcacggatgcggtcgattgttcgcaaaatccgctggcggaactgaaatgctcggtcaagtcgtttgagatcgacaaagggatctaccagacgtcgaatttccgggtcgtcccgtcgggggatgtcgtccggttcccgaatatcacgaacctgtgtccgtttggggaggtctttaatgcgacgaaattcccgtcggtctatgcgtgggagcggaaaaaaatctcgaattgtgtcgcggattactcggtcctgtacaactcgacgtttttttcgacgtttaagtgctatggggtctcggcgacgaagctgaatgatctgtgcttctcgaatgtctatgcggattcgtttgtcgtcaagggggatgatgtccggcaaatcgcgccggggcaaacgggggtcatcgcggattataattataaactgccggatgatttcatggggtgtgtcctggcgtggaatacgcggaacatcgatgcgacgtcgacggggaattataattataaatatcggtatctgcggcatgggaagctgcggccgtttgagcgggacatctcgaatgtcccgttctcgccggatgggaaaccgtgcacgccgccggcgctgaattgttattggccgctgaatgattatgggttttacacgacgacggggatcgggtaccaaccgtaccgggtcgtcgtcctgtcgtttgaactgctgaatgcgccggcgacggtctgtgggccgaaactgtcgacggacctgatcaagaaccagtgtgtcaattttaattttaatgggctgacggggacgggggtcctgacgccgtcgtcgaagcggtttcaaccgtttcaacaatttgggcgggatgtctcggatttcacggattcggtccgggatccgaaaacgtcggaaatcctggacatctcgccgtgctcgtttgggggggtctcggtcatcacgccggggacgaatgcgtcgtcggaagtcgcggtcctgtatcaagatgtcaactgcacggatgtctcgacggcgatccatgcggatcaactgacgccggcgtggcggatctattcgacggggaacaatgtcttccagacgcaagcggggtgtctgatcggggcggagcatgtcgacacgtcgtatgagtgcgacatcccgatcggggcggggatctgtgcgtcgtaccatacggtctcgctgctgcggtcgacgtcgcaaaaatcgatcgtcgcgtatacgatgtcgctgggggcggattcgtcgatcgcgtactcgaataacacgatcgcgatcccgacgaacttttcgatctcgatcacgacggaagtcatgccggtctcgatggcgaaaacgtcggtcgattgtaatatgtacatctgcggggattcgacggaatgtgcgaatctgctgctgcaatatgggtcgttttgcacgcaactgaatcgggcgctgtcggggatcgcggcggaacaggatcggaacacgcgggaagtcttcgcgcaagtcaaacaaatgtacaaaacgccgacgctgaaatattttggggggtttaatttttcgcaaatcctgccggacccgctgaagccgacgaagcggtcgtttatcgaggacctgctgtttaataaggtcacgctggcggatgcggggttcatgaagcaatatggggaatgcctgggggatatcaatgcgcgggatctgatctgtgcgcagaagttcaatgggctgacggtcctgccgccgctgctgacggatgatatgatcgcggcgtacacggcggcgctggtctcggggacggcgacggcggggtggacgtttggggcgggggcggcgctgcaaatcccgtttgcgatgcaaatggcgtatcggttcaatgggatcggggtcacgcaaaatgtcctgtatgagaaccaaaaacaaatcgcgaaccaatttaacaaggcgatctcgcaaatccaagaatcgctgacgacgacgtcgacggcgctggggaagctgcaagacgtcgtcaaccagaatgcgcaagcgctgaacacgctggtcaaacaactgtcgtcgaattttggggcgatctcgtcggtcctgaatgatatcctgtcgcggctggataaagtcgaggcggaggtccaaatcgaccggctgatcacggggcggctgcaatcgctgcaaacgtatgtcacgcaacaactgatccgggcggcggaaatccgggcgtcggcgaatctggcggcgacgaaaatgtcggagtgtgtcctggggcaatcgaaacgggtcgacttttgtgggaaggggtaccacctgatgtcgttcccgcaagcggcgccgcatggggtcgtcttcctgcatgtcacgtatgtcccgtcgcaggagcggaacttcacgacggcgccggcgatctgtcatgaagggaaagcgtacttcccgcgggaaggggtctttgtctttaatgggacgtcgtggtttatcacgcagcggaacttcttttcgccgcaaatcatcacgacggacaatacgtttgtctcggggaattgtgatgtcgtcatcgggatcatcaacaacacggtctatgatccgctgcaaccggagctggactcgttcaaagaagagctggacaagtacttcaaaaatcatacgtcgccggatgtcgatctgggggacatctcggggatcaacgcgtcggtcgtcaacatccaaaaagaaatcgaccggctgaatgaggtcgcgaaaaatctgaatgaatcgctgatcgacctgcaagaactggggaaatatgagcaatatatcaaatggccgtggtatgtctggctggggttcatcgcggggctgatcgcgatcgtcatggtcacgatcctgctgtgttgcatgacgtcgtgttgctcgtgcctgaagggggcgtgctcgtgtgggtcgtgctgcaagtttgatgaggatgactcggagccggtcctgaagggggtcaaactgcattacacgtaa

SEQ ID NO: 15 - DNA, 9762 bp, Rubella virus
  CDS (41)..(6391)
  CDS (6512)..(9703)
caatgggagctatcggacctcgcttaggactcctattcccatggagagactcctagatgaggttcttgcccccggtgggccttataacttaaccgtcggcagttgggtaagagaccacgtccgctcaattgtcgagggcgcgtgggaagtgcgcgatgttgtttccgctgcccaaaagcgggccatcgtagccgtgatacccagacctgtgttcacgcagatgcaggtcagtgatcacccagcactccacgcaatttcgcggtatacccgccgccattggatcgagtggggccctaaagaagccctacacgtcctcatcgacccaagcccgggcctgctccgcgaggtcgctcgcgttgagcgccgctgggtcgcactgtgcctccacaggacggcacgcaaactcgccaccgccctggccgagacggccagcgaggcgtggcacgctgactacgtgtgcgcgctgcgtggcgcaccgagcggccccttctacgtccaccctgaggacgtcccgcacggcggtcgcgccgtggcggacagatgcttgctctactacacacccatgcagatgtgcgagctgatgcgtaccattgacgccaccctgctcgtggcggtcgacttgtggccggtcgcccttgcggcccacgtcggcgacgactgggacgacctgggcattgcctggcatctcgaccatgacggcggttgccccgccgattgccgcggagccggcgctgggcccacgcccggctacacccgcccctgcaccacacgcatctaccaagtcctgccggacaccgcccaccccgggcgcctctaccggtgcgggccccgcctgtggacgcgcgattgcgccgtggccgaactctcatgggaggttgcccaacactgcgggcaccaggcgcgcgtgcgcgccgtgcggtgcaccctccctatccgccacgtgcgcagcctccaacccagcgcgcgggtccgactcccggacctcgtccatctcgccgaggtgggccggtggcggtggttcagcctcccccgccccgtgttccagcgcatgctgtcctactgcaagaccctgagccccgacgcgtactacagcgagcgcgtgttcaagttcaagaacgccctgagccacagcatcacgctcgcgggcaatgtgctgcaagaggggtggaagggcacgtgcgccgaggaagacgcgctgtgcgcatacgtagccttccgcgcgtggcagtctaacgccaggttggcggggattatgaaaagcgcgaagcgctgcgccgccgactctttgagcgtggccggctggctggacaccatttggggcgccattaagcggttcttcggcagcgtgcccctcgccgagcgcatggaggagtgggaacaggacgccgcggtcgccgccttcgaccgcggccccctcgaggacggcgggcgccacttggacaccgtgcaacccccaaaatcgccgccccgccctgagatcgccgcgacctggatcgtccacgcagccagcgcagaccgccattgtgcgtgcgctccccgctgcgacgtcccgcgcgaacgtccttccgcgcccgccggcccgccggatgacgaggcgctcatcccgccgtggctgttcgccgagcaccgtgccctccgctgccgcgagtgggatttcgaggttctccgcgcgcgcgccgatacggcggccgcgcccgccccgctggctccacgccctgcgcggtaccccaccgtgctctaccgccaccccgcccaccacggtccgtggctcacccttgacgagccgggcgaggctgacgcggccctggtcctatgcgacccacttggccagccgctccggggccctgaacgccacttcgccgccggcgcgcatatgtgcgcgcaggcgcgggggctccaggcttttgtccgtgtcgtgcctccacccgagcgcccctgggccgacgggggcgccagagcgtgggcgaagttcttccgcggctgcgcctgggcgcagcgcttgctcggcgagccagcagttatgcacctcccatacaccgatggcgacgtgccacagctgatcgcactggctttgcgcacgctggcccaacagggggccgccttggcactctcggtgcgtgacctgcccgggggtgcagcgttcgacgcaaacgcggtcaccgccgccgtgcgcgctggccccggccagtccgcggccacgtcatcgccacccggcgaccccccgccgccgcgctgcgcacggcgatcgcaacggcactcggacgcccgcggcactccgccccccgcgcctgcgcgcgacccgccgccgcccgcccccagcccgcccgcgccaccccgcgcgggtgacccggtccctcccacttccgcggggccggcggatcgcgcgcgtgacgccgagctggaggtcgcctacgaaccgagcggcccccccacgtcaaccaaggcagacccagacagcgacatcgttgaaagttacgcccgcgccgccggacccgtgcacctccgagtccgcgacatcatggacccaccgcccggctgcaaggtcgtggtcaacgccgccaacgaggggctgctggccggctctggcgtgtgcggtgccatctttgccaacgccacggcggccctcgctgcagactgccggcgcctcgccccatgccccaccggcgaggcagtggcgacacccggccacggctgcgggtacacccacatcatccacgccgtcgcgccgcggcgtcctcgggaccccgccgccctcgaggagggcgaagcgctgctcgagcgcgcctaccgcagcatcgtcgcgctagccgccgcgcgtcggtgggcgcgtgtcgcgtgccccctcctcggcgctggcgtctacggctggtctgctgcggagtccctccgagccgcgctcgcggctacgcgcaccgagcccgccgagcgcgtgagcctgcacatctgccatcccgaccgcgccacgctgacgcacgcctccgtgctcgtcggcgcggggctcgctgccaggcgcgtcagtcctcctccgaccgagcccctcgcatcttgccccgccggtgacccgggccgaccggctcagcgcagcgcgtcgcccccagcgaccccccttggggatgccaccgcgcccgagccccgcggatgccaggggtgcgaactctgccggtacacgcgcgtcaccaatgaccgcgcctatgtcaacctgtggctcgagcgcgaccgcggcgccaccagctgggccatgcgcattcccgaggtggttgtctacgggccggagcacctcgccacgcattttccattaaaccactacagtgtgctcaagcccgcggaggtcaggcccccgcgaggcatgtgcgggagtgacatgtggcgctgccgcggctggcagggcgtgccgcaggtgcggtgcaccccctccaacgctcacgccgccctgtgccgcacaggcgtgccccctcgggtgagcacgcgaggcggcgagctagacccaaacacctgctggctccgcgccgccgccaacgttgcgcaggctgcgcgcgcctgcggcgcctacacgagtgccgggtgccccaggtgcgcctacggccgcgccctgagcgaagcccgcactcataaggacttcgccgcgctgagccagcggtggagcgcgagccacgccgatgcctcctctgacggcaccggagatcccctcgaccccctgatggagaccgtgggatgcgcctgttcgcgcgtgtgggtcggctccgagcacgaggccccgcccgaccacctcctggtgtccctccaccgtgccccaaatggtccgtggggcgtagtgctcgaggtgcgtgcgcgccccgaggggggcaaccccaccggccacttcgtctgcgcggtcggcggcggcccacgccgcgtctcggaccgcccccacctttggctcgcggtccccctgtctcggggcggtggcacctgtgccgcgaccgacgaggggctggcccaggcgtactacgacgacctcgaggtgcgccgcctcggggatgacgccatggcccgggcggccctcgcatcagtccaacgccctcgcaaaggcccttacaatatcagggtatggaacatggccgcaggcgctggcaagaccacccgcatcctcgctgccttcacgcgcgaagacctttacgtctgccccaccaatgcgctcctgcacgagatccaggccaaactccgcgcgcgcgatatcgagatcaagaacgccgccacctacgagcgcgcgctgacgaaaccgctcgccgcctaccgccgcatctacatcgatgaggcgttcactctcggcggcgagtactgcgcgttcgttgccagccaaaccaccgcggaggtgatctgcgtcggtgatcgggaccagtgcggcccacactacgccaataactgccgcacccccgtccctgaccgctggcctaccgagcgctcgcgccacacttggcgcttccccgactgctgggcggcccgcctgcgcgcggggctcgattatgacatcgagggcgagcgcaccggcaccttcgcctgcaacctttgggacggccgccaggtcgaccttcacctcgccttctcgcgcgaaaccgtgcgccgccttcacgaggctggcatacgcgcatacaccgtgcgcgaggcccagggtatgagcgtcggcaccgcctgcatccatgtaggcagagacggcaccgacgttgccctggcgctgacacgcgacctcgccatcgtcagcctgacccgggcctccgacgcactctacctccacgagctcgaggacggctcactgcgcgctgcggggctcagcgcgttcctcgacgccggggcactggcggagctcaaggaggttcccgctggcattgaccgcgttgtcgccgtcgagcaggcaccaccaccgttgccgcccgccgacggcatccccgaggcccaagacgtgccgcccttctgcccccgcactctggaggagctcgtcttcggccgtgccggccacccccattacgcggacctcaaccgcgtgactgagggcgaacgagaagtgcggtatatgcgcatctcgcgtcacctgctcaacaagaatcacaccgagatgcccggaacggaacgcgttctcagtgccgtttgcgccgtgcggcgctaccgcgcgggcgaggatgggtcgaccctccgcactgctgtggcccgccagcacccgcgcccttttcgccagatcccacccccgcgcgtcactgctggggtcgcccaggagtggcgcatgacgtacttgcgggaacggatcgacctcactgacgtctacacgcagatgggcgtggccgcgcgggagctcaccgaccgctacgcgcgccgctatcctgagatcttcgccggcatgtgtaccgcccagagcctgagcgtccccgccttcctcaaagccaccttgaagtgcgtagacgccgccctcggccccagggacaccgaggactgccacgccgctcaggggaaagccggccttgagatccgtgcgtgggccaaggagtgggttcaggttatgtccccgcatttccgcgcgatccagaagatcatcatgcgcgccttgcgcccgcaattccttgtggccgctggccatacggagcccgaggtcgatgcgtggtggcaggctcattacaccaccaacgccatcgaggtcgacttcactgagttcgacatgaaccagaccctcgctactcgggacgtcgagctcgagattagcgccgctctcttgggcctcccttgcgccgaagactaccgcgcgctccgcgccggcagctactgcaccctgcgcgaactgggctccactgagaccggctgcgagcgcacaagcggcgagcccgccacgctgctgcacaacaccaccgtggccatgtgcatggccatgcgcatggtccccaaaggcgtgcgctgggctgggattttccagggtgacgatatggtcatcttcctccccgagggcgcgcgcagtgcggcactcaagtggacccccgccgaggtgggcttgttcggcttccacatcccggtgaagcatgtgagcacccctacccccagcttctgcgggcacgtcggcaccgcggccggcctcttccatgatgtcatgcaccaggcgatcaaggtgctttgccgccgtttcgacccagacgtgcttgaagaacagcaggtggccctcctcgaccgcctccggggggtctacgcggctctgcctgacaccgttgccgccaatgctgcgtactacgactacagcgcggagcgcgtcctcgctatcgtgcgcgaacttaccgcgtacgcgcgggggcgcggcctcgaccacccggccaccatcggcgcgctcgaggagattcagaccccctacgcgcgcgccaatctccacgacgctgactaacgcccctgtacgtggggcctttaatcttacctactctaaccaggtcatcacccaccgttgtttcgccgcatctggtgggtacccaacttttgccattcgggagagccccagggtgcccgaatggcttctactacccccatcaccatggaggacctccagaaggccctcgagacacaatcccgcgccctgcgcgcggaactcgccgccggcgcctcgcagtcgcgccggccgcggccgccgcgacagcgcgactccagcaccaccggagatgactccggccgtgactccggagggccccgccgccgccgcggcaaccggggccgtggccagcgcagggactggtccagggccccgccccccccggaggagcggcaagaaactcgctcccagactccggccccgaagccatcgcgggcgccgccacaacagcctcaacccccgcgtatgcaaaccgggcgtgggggctctgccccgcgccccgagctggggccaccgaccaacccgttccaagcagccgtggcgcgtggcctgcgcccgcctctccacgaccctgacaccgaggcacccaccgaggcctgcgtgacctcatggctttggagcgagggcgaaggcgcggtcttttaccgcgtcgacctgcatttcaccaacctgggcacccccccactcgacgaggacggccgctgggaccctgcgctcatgtacaacccttgcgggcccgagccgcccgctcacgtcgtccgcgcgtacaatcaacctgccggcgacgtcaggggcgtttggggtaaaggtgagcgcacctacgccgagcaggatttccgcgtcggcggcacgcgctggcaccgactgctgcgcatgccagtgcgcggcctcgacggcgacagcgccccgcttcccccccacaccaccgagcgcattgagacccgctcggcgcgccatccttggcgcatccgcttcggtgccccccaggccttccttgccgggctcttgctcgccgcggtcgccgttggcaccgcgcgcgccgggctccagccccgcgctgatatggcggcacctcctacgctgccgcagcccccccgtgcgcacgggcagcattacggccaccaccaccatcagctgccgttcctcgggcacgacggccatcatggcggcaccttgcgcgtcggccagcatcaccgaaacgccagcgacgtgctgcccggccactggctccaaggcggctggggttgctacaacctgagcgactggcaccagggcactcatgtctgtcacaccaagcacatggacttttggtgtgtggagcacgaccgaccgccgcccgcgaccccgacgcctctcaccaccgcggcgaactccacgaccgccgccacccccgccactgcgccggccccctgccacgccggcctcaatgacagctgcggcggcttcttgtctgggtgcgggccgatgcgcctgcgccacggcgctgacacccggtgcggtcggttgatctgcgggctgtctaccaccgcccagtacccgcctacccggtttggctgcgctatgcggtggggccttcccccctgggaactggtcgtccttaccgcccgccccgaagacggctggacttgccgcggcgtgcccgcccacccaggcacccgctgccccgaactggtgagccccatgggacgcgcgacttgctccccagcctcggccctctggctcgccacagcgaacgcgctgtctcttgatcacgccctcgcggccttcgtcctgctggtcccgtgggtcctgatattcatggtgtgccgccgcacctgtcgccgccgcggcgccgccgccgccctcaccgcggtcgtcctgcaggggtacaacccccccgcctatggcgaggaggctttcacctacctctgcactgcaccggggtgcgccactcaagcacctgtccccgtgcgcctcgctggcgtccgctttgagtccaagattgtggacggcggctgctttgccccatgggacctcgaggccactggagcctgcatttgcgagatccccactgatgtctcgtgcgagggcttgggggcctgggtacccacagccccttgcgcgcgcatctggaatggcacacagcgcgcgtgcaccttctgggctgtcaacgcctactcctctggcgggtacgcgcagctggcctcttacttcaaccctggcggcagctactacaagcagtaccaccctaccgcgtgcgaggttgaacctgccttcggacacagcgacgcggcctgctggggcttccccaccgacaccgtgatgagcgtgttcgcccttgctagctacgtccagcaccctcacaagaccgtccgggtcaagttccatacagagaccaggaccgtctggcaactctccgttgctggcgtgtcgtgcaacgtcaccactgaacacccgttctgcaacacgccgcacggacaactcgaggtccaggtcccgcccgaccccggggacctggttgagtacattatgaaccacaccggcaatcagcagtcccggtggggcctcgggagcccgaattgccatggccccgattgggcctccccggtttgccaacgccattcccctgactgctcgcggcttgtgggggctacgccagagcgtccccggctgcgcctggtcgacgccgacgaccccctgctgcgcactgcccctgggcccggcgaggtgtgggtcacgcctgtcataggctctcaggcgcgcaagtgcggactccacatacgcgctggaccgtacggccatgctaccgtcgaaatgcccgagtggatccacgcccacaccaccagcgacccctggcacccaccgggccccttggggctgaagttcaagacagttcgcccggtggccctgccacgcacgttagcgccaccccgcaatgtgcgtgtgaccgggtgctaccagtgcggtacccccgcgctggtggaaggccttgcccccgggggagggaattgccatctcaccgtcaatggcgaggatctcggcgccttcccccctgggaagttcgtcaccgccgccctcctcaacacccccccgccctaccaagtcagctgcgggggcgagagcgatcgcgcgagcgcgcgggtcattgaccccgccgcgcaatcgtttaccggcgtggtgtatggcacacacaccactgctgtgtcggagacccggcagacctgggcggagtgggctgctgcccattggtggcagctcactctgggcgccatttgcgccctcctactcgctggcttactcgcttgctgtgccaaatgcttgtactacttgcgcggcgctatagcgccgcgctagtgggcccccgcgcgaaacccgcactagcccactagattcccgcacctgttgctgcatag

SEQ ID NO: 16 - protein, 2116 aa, Rubella virus
MERLLDEVLAPGGPYNLTVGSWVRDHVRSIVEGAWEVRDVVSAAQKRAIVAVIPRPVFTQMQVSDHPALHAISRYTRRHWIEWGPKEALHVLIDPSPGLLREVARVERRWVALCLHRTARKLATALAETASEAWHADYVCALRGAPSGPFYVHPEDVPHGGRAVADRCLLYYTPMQMCELMRTIDATLLVAVDLWPVALAAHVGDDWDDLGIAWHLDHDGGCPADCRGAGAGPTPGYTRPCTTRIYQVLPDTAHPGRLYRCGPRLWTRDCAVAELSWEVAQHCGHQARVRAVRCTLPIRHVRSLQPSARVRLPDLVHLAEVGRWRWFSLPRPVFQRMLSYCKTLSPDAYYSERVFKFKNALSHSITLAGNVLQEGWKGTCAEEDALCAYVAFRAWQSNARLAGIMKSAKRCAADSLSVAGWLDTIWGAIKRFFGSVPLAERMEEWEQDAAVAAFDRGPLEDGGRHLDTVQPPKSPPRPEIAATWIVHAASADRHCACAPRCDVPRERPSAPAGPPDDEALIPPWLFAEHRALRCREWDFEVLRARADTAAAPAPLAPRPARYPTVLYRHPAHHGPWLTLDEPGEADAALVLCDPLGQPLRGPERHFAAGAHMCAQARGLQAFVRVVPPPERPWADGGARAWAKFFRGCAWAQRLLGEPAVMHLPYTDGDVPQLIALALRTLAQQGAALALSVRDLPGGAAFDANAVTAAVRAGPGQSAATSSPPGDPPPPRCARRSQRHSDARGTPPPAPARDPPPPAPSPPAPPRAGDPVPPTSAGPADRARDAELEVAYEPSGPPTSTKADPDSDIVESYARAAGPVHLRVRDIMDPPPGCKVVVNAANEGLLAGSGVCGAIFANATAALAADCRRLAPCPTGEAVATPGHGCGYTHIIHAVAPRRPRDPAALEEGEALLERAYRSIVALAAARRWARVACPLLGAGVYGWSAAESLRAALAATRTEPAERVSLHICHPDRATLTHASVLVGAGLAARRVSPPPTEPLASCPAGDPGRPAQRSASPPATPLGDATAPEPRGCQGCELCRYTRVTNDRAYVNLWLERDRGATSWAMRIPEVVVYGPEHLATHFPLNHYSVLKPAEVRPPRGMCGSDMWRCRGWQGVPQVRCTPSNAHAALCRTGVPPRVSTRGGELDPNTCWLRAAANVAQAARACGAYTSAGCPRCAYGRALSEARTHKDFAALSQRWSASHADASSDGTGDPLDPLMETVGCACSRVWVGSEHEAPPDHLLVSLHRAPNGPWGVVLEVRARPEGGNPTGHFVCAVGGGPRRVSDRPHLWLAVPLSRGGGTCAATDEGLAQAYYDDLEVRRLGDDAMARAALASVQRPRKGPYNIRVWNMAAGAGKTTRILAAFTREDLYVCPTNALLHEIQAKLRARDIEIKNAATYERALTKPLAAYRRIYIDEAFTLGGEYCAFVASQTTAEVICVGDRDQCGPHYANNCRTPVPDRWPTERSRHTWRFPDCWAARLRAGLDYDIEGERTGTFACNLWDGRQVDLHLAFSRETVRRLHEAGIRAYTVREAQGMSVGTACIHVGRDGTDVALALTRDLAIVSLTRASDALYLHELEDGSLRAAGLSAFLDAGALAELKEVPAGIDRVVAVEQAPPPLPPADGIPEAQDVPPFCPRTLEELVFGRAGHPHYADLNRVTEGEREVRYMRISRHLLNKNHTEMPGTERVLSAVCAVRRYRAGEDGSTLRTAVARQHPRPFRQIPPPRVTAGVAQEWRMTYLRERIDLTDVYTQMGVAARELTDRYARRYPEIFAGMCTAQSLSVPAFLKATLKCVDAALGPRDTEDCHAAQGKAGLEIRAWAKEWVQVMSPHFRAIQKIIMRALRPQFLVAAGHTEPEVDAWWQAHYTTNAIEVDFTEFDMNQTLATRDVELEISAALLGLPCAEDYRALRAGSYCTLRELGSTETGCERTSGEPATLLHNTTVAMCMAMRMVPKGVRWAGIFQGDDMVIFLPEGARSAALKWTPAEVGLFGFHIPVKHVSTPTPSFCGHVGTAAGLFHDVMHQAIKVLCRRFDPDVLEEQQVALLDRLRGVYAALPDTVAANAAYYDYSAERVLAIVRELTAYARGRGLDHPATIGALEEIQTPYARANLHDAD

SEQ ID NO: 17 - protein, 1063 aa, Rubella virus
MASTTPITMEDLQKALETQSRALRAELAAGASQSRRPRPPRQRDSSTTGDDSGRDSGGPRRRRGNRGRGQRRDWSRAPPPPEERQETRSQTPAPKPSRAPPQQPQPPRMQTGRGGSAPRPELGPPTNPFQAAVARGLRPPLHDPDTEAPTEACVTSWLWSEGEGAVFYRVDLHFTNLGTPPLDEDGRWDPALMYNPCGPEPPAHVVRAYNQPAGDVRGVWGKGERTYAEQDFRVGGTRWHRLLRMPVRGLDGDSAPLPPHTTERIETRSARHPWRIRFGAPQAFLAGLLLAAVAVGTARAGLQPRADMAAPPTLPQPPRAHGQHYGHHHHQLPFLGHDGHHGGTLRVGQHHRNASDVLPGHWLQGGWGCYNLSDWHQGTHVCHTKHMDFWCVEHDRPPPATPTPLTTAANSTTAATPATAPAPCHAGLNDSCGGFLSGCGPMRLRHGADTRCGRLICGLSTTAQYPPTRFGCAMRWGLPPWELVVLTARPEDGWTCRGVPAHPGTRCPELVSPMGRATCSPASALWLATANALSLDHALAAFVLLVPWVLIFMVCRRTCRRRGAAAALTAVVLQGYNPPAYGEEAFTYLCTAPGCATQAPVPVRLAGVRFESKIVDGGCFAPWDLEATGACICEIPTDVSCEGLGAWVPTAPCARIWNGTQRACTFWAVNAYSSGGYAQLASYFNPGGSYYKQYHPTACEVEPAFGHSDAACWGFPTDTVMSVFALASYVQHPHKTVRVKFHTETRTVWQLSVAGVSCNVTTEHPFCNTPHGQLEVQVPPDPGDLVEYIMNHTGNQQSRWGLGSPNCHGPDWASPVCQRHSPDCSRLVGATPERPRLRLVDADDPLLRTAPGPGEVWVTPVIGSQARKCGLHIRAGPYGHATVEMPEWIHAHTTSDPWHPPGPLGLKFKTVRPVALPRTLAPPRNVRVTGCYQCGTPALVEGLAPGGGNCHLTVNGEDLGAFPPGKFVTAALLNTPPPYQVSCGGESDRASARVIDPAAQSFTGVVYGTHTTAVSETRQTWAEWAAAHWWQLTLGAICALLLAGLLACCAKCLYYLRGAIAPR

SEQ ID NO: 18 - DNA, 9762 bp, Artificial
  deoptimized rubella sequence
caatgggagctatcggacctcgcttaggactcctattcccatggagagattattagatgaggtattagcaccaggaggaccatataacttaacagtaggatcatgggtaagagaccacgtaagatcaattgtagagggagcatgggaagtaagagatgtagtatcagcagcacaaaagagagcaatcgtagcagtaataccaagaccagtattcacgcagatgcaggtatcagatcacccagcattacacgcaatttcaagatatacaagaagacattggatcgagtggggaccaaaagaagcattacacgtattaatcgacccatcaccaggattattaagagaggtagcaagagtagagagaagatgggtagcattatgtttacacagaagagcaagaaaattagcaacagcattagcagagagagcatcagaggcatggcacgcagactatgtatgtgcattaagaggagcaccatcaggaccattctatgtacacccagaggacgtaccacacggaggaagagcagtagcagacagatgtttattatattatacaccaatgcagatgtgtgagttaatgagaacaattgacgcaacattattagtagcagtagacttatggccagtagcattagcagcacacgtaggagacgactgggacgacttaggaattgcatggcatttagaccatgacggaggatgtccagcagattgtagaggagcaggagcaggaccaagaccaggatatacaagaccatgtacaacaagaatctatcaagtattaccagacacagcacacccaggaagattatatagatgtggaccaagattatggagaagagattgtgcagtagcagaattatcatgggaggtagcacaacactgtggacaccaggcaagagtaagagcagtaagatgtacattaccaatcagacacgtaagatcattacaaccatcagcaagagtaagattaccagacttagtacatttagcagaggtaggaagatggagatggttctcattaccaagaccagtattccagagaatgttatcatattgtaagacattatcaccagacgcatattattcagagagagtattcaagttcaagaacgcattatcacactcaatcagattagcaggaaatgtattacaagagggatggaagggaagatgtgcagaggaagacgcattatgtgcatatgtagcattcagagcatggcagtcaaacgcaagattagcaggaattatgaaatcagcaaagagatgtgcagcagactcattatcagtagcaggatggttagacacaatttggggagcaattaagagattcttcggatcagtaccattagcagagagaatggaggagtgggaacaggacgcagcagtagcagcattcgacagaggaccattagaggacggaggaagacacttagacacagtacaaccaccaaaatcaccaccaagaccagagatcgcagcaacatggatcgtacacgcagcatcagcagacagacattgtgcatgtgcaccaagatgtgacgtaccaagagaaagaccatcagcaccagcaggaccaccagatgacgaggcattaatcccaccatggttattcgcagagcacagagcattaagatgtagagagtgggatttcgaggtattaagagcaagagcagatagagcagcagcaccagcaccattagcaccaagaccagcaagatatccaacagtattatatagacacccagcacaccacggaccatggttaacattagacgagccaggagaggcagacgcagcattagtattatgtgacccattaggacagccattaagaggaccagaaagacacttcgcagcaggagcacatatgtgtgcacaggcaagaggattacaggcatttgtaagagtagtaccaccaccagagagaccatgggcagacggaggagcaagagcatgggcaaagttcttcagaggatgtgcatgggcacagagattattaggagagccagcagtaatgcacttaccatatacagatggagacgtaccacagttaatcgcattagcattaagaagattagcacaacagggagcagcattagcattatcagtaagagacttaccaggaggagcagcattcgacgcaaacgcagtaacagcagcagtaagagcaggaccaggacagtcagcagcaagatcatcaccaccaggagacccaccaccaccaagatgtgcaagaagatcacaaagacactcagacgcaagaggaacaccaccaccagcaccagcaagagacccaccaccaccagcaccatcaccaccagcaccaccaagagcaggagacccagtaccaccaacatcagcaggaccagcagatagagcaagagacgcagagttagaggtagcatatgaaccatcaggaccaccaagatcaacaaaggcagacccagactcagacatcgtagaatcatatgcaagagcagcaggaccagtacacttaagagtaagagacatcatggacccaccaccaggatgtaaggtagtagtaaacgcagcaaacgagggattattagcaggatcaggagtatgtggagcaatctttgcaaacgcaagagcagcattagcagcagactgtagaagattagcaccatgtccaacaggagaggcagtagcaacaccaggacacggatgtggatatacacacatcatccacgcagtagcaccaagaagaccaagagacccagcagcattagaggagggagaagcattattagagagagcatatagatcaatcgtagcattagcagcagcaagaagatgggcaagagtagcatgtccattattaggagcaggagtatatggatggtcagcagcagagtcattaagagcagcattagcagcaagaagaacagagccagcagagagagtatcattacacatctgtcatccagacagagcaagattaagacacgcatcagtattagtaggagcaggattagcagcaagaagagtatcaccaccaccaacagagccattagcatcatgtccagcaggagacccaggaagaccagcacagagatcagcatcaccaccagcaacaccattaggagatgcaacagcaccagagccaagaggatgtcagggatgtgaattatgtagatatagaagagtaacaaatgacagagcatatgtaaacttatggttagagagagacagaggagcaacatcatgggcaatgagaattccagaggtagtagtatatggaccagagcacttagcaagacattttccattaaaccactattcagtattaaagccagcagaggtaagaccaccaagaggaatgtgtggatcagacatgtggagatgtagaggatggcagggagtaccacaggtaagatgtacaccatcaaacgcacacgcagcattatgtagaacaggagtaccaccaagagtatcaagaagaggaggagagttagacccaaacacatgttggttaagagcagcagcaaacgtagcacaggcagcaagagcatgtggagcatatagatcagcaggatgtccaagatgtgcatatggaagagcattatcagaagcaagaacacataaggacttcgcagcattatcacagagatggtcagcatcacacgcagatgcatcatcagacggaacaggagatccattagacccattaatggagacagtaggatgtgcatgttcaagagtatgggtaggatcagagcacgaggcaccaccagaccacttattagtatcattacacagagcaccaaatggaccatggggagtagtattagaggtaagagcaagaccagagggaggaaacccaacaggacacttcgtatgtgcagtaggaggaggaccaagaagagtatcagacagaccacacttatggttagcagtaccattatcaagaggaggaggaacatgtgcagcaacagacgagggattagcacaggcatattatgacgacttagaggtaagaagattaggagatgacgcaatggcaagagcagcattagcatcagtacaaagaccaagaaaaggaccatataatatcagagtatggaacatggcagcaggagcaggaaagacaacaagaatcttagcagcattcagaagagaagacttatatgtatgtccaacaaatgcattattacacgagatccaggcaaaattaagagcaagagatatcgagatcaagaacgcagcaacatatgagagagcattaagaaaaccattagcagcatatagaagaatctatatcgatgaggcattcacattaggaggagagtattgtgcattcgtagcatcacaaacaacagcagaggtaatctgtgtaggagatagagaccagtgtggaccacactatgcaaataactgtagaacaccagtaccagacagatggccaacagagagatcaagacacacatggagattcccagactgttgggcagcaagattaagagcaggattagattatgacatcgagggagagagaacaggaacattcgcatgtaacttatgggacggaagacaggtagacttacacttagcattctcaagagaaacagtaagaagattacacgaggcaggaataagagcatatacagtaagagaggcacagggaatgtcagtaggaacagcatgtatccatgtaggaagagacggaacagacgtagcattagcattaacaagagacttagcaatcgtatcattaacaagagcatcagacgcattatatttacacgagttagaggacggatcattaagagcagcaggattatcagcattcttagacgcaggagcattagcagagttaaaggaggtaccagcaggaattgacagagtagtagcagtagagcaggcaccaccaccattaccaccagcagacggaatcccagaggcacaagacgtaccaccattctgtccaagaacattagaggagttagtattcggaagagcaggacacccacattatgcagacttaaacagagtaacagagggagaaagagaagtaagatatatgagaatctcaagacacttattaaacaagaatcacacagagatgccaggaagagaaagagtattatcagcagtatgtgcagtaagaagatatagagcaggagaggatggatcaacattaagaacagcagtagcaagacagcacccaagaccatttagacagatcccaccaccaagagtaacagcaggagtagcacaggagtggagaatgagatatttaagagaaagaatcgacttaacagacgtatatagacagatgggagtagcagcaagagagttaacagacagatatgcaagaagatatccagagatcttcgcaggaatgtgtacagcacagtcattatcagtaccagcattcttaaaagcaacattaaagtgtgtagacgcagcattaggaccaagagacacagaggactgtcacgcagcacagggaaaagcaggattagagatcagagcatgggcaaaggagtgggtacaggtaatgtcaccacatttcagagcaatccagaagatcatcatgagagcattaagaccacaattcttagtagcagcaggacatagagagccagaggtagatgcatggtggcaggcacattatacaacaaacgcaatcgaggtagacttcacagagttcgacatgaaccagacattagcaacaagagacgtagagttagagatttcagcagcattattaggattaccatgtgcagaagactatagagcattaagagcaggatcatattgtacattaagagaattaggatcaacagagacaggatgtgagagaacatcaggagagccagcaagattattacacaacacaacagtagcaatgtgtatggcaatgagaatggtaccaaaaggagtaagatgggcaggaattttccagggagacgatatggtaatcttcttaccagagggagcaagatcagcagcattaaagtggacaccagcagaggtaggattattcggattccacatcccagtaaagcatgtatcaacaccaacaccatcattctgtggacacgtaggaacagcagcaggattattccatgatgtaatgcaccaggcaatcaaggtattatgtagaagattcgacccagacgtattagaagaacagcaggtagcattattagacagattaagaggagtatatgcagcattaccagacacagtagcagcaaatgcagcatattatgactattcagcagagagagtattagcaatcgtaagagaattaacagcatatgcaagaggaagaggattagaccacccagcaacaatcggagcattagaggagattcagacaccatatgcaagagcaaatttacacgacgcagactaacgcccctgtacgtggggcctttaatcttacctactctaaccaggtcatcacccaccgttgtttcgccgcatctggtgggtacccaacttttgccattcgggagagccccagggtgcccgaatggcatcaacaacaccaatcacaatggaggacttacagaaggcattagagacacaatcaagagcattaagagcagaattagcagcaggagcatcacagtcaagaagaccaagaccaccaagacagagagactcatcaacaacaggagatgactcaggaagagactcaggaggaccaagaagaagaagaggaaacagaggaagaggacagagaagagactggtcaagagcaccaccaccaccagaggagagacaagaaacaagatcacagacaccagcaccaaagccatcaagagcaccaccacaacagccacaaccaccaagaatgcaaacaggaagaggaggatcagcaccaagaccagagttaggaccaccaacaaacccattccaagcagcagtagcaagaggattaagaccaccattacacgacccagacacagaggcaccaacagaggcatgtgtaacatcatggttatggtcagagggagaaggagcagtattttatagagtagacttacatttcacaaacttaggaacaccaccattagacgaggacggaagatgggacccagcattaatgtataacccatgtggaccagagccaccagcacacgtagtaagagcatataatcaaccagcaggagacgtaagaggagtatggggaaaaggagagagaacatatgcagagcaggatttcagagtaggaggaagaagatggcacagattattaagaatgccagtaagaggattagacggagactcagcaccattaccaccacacacaacagagagaattgagacaagatcagcaagacatccatggagaatcagattcggagcaccacaggcattcttagcaggattattattagcagcagtagcagtaggaacagcaagagcaggattacagccaagagcagatatggcagcaccaccaagattaccacagccaccaagagcacacggacagcattatggacaccaccaccatcagttaccattcttaggacacgacggacatcatggaggaacattaagagtaggacagcatcacagaaacgcatcagacgtattaccaggacactggttacaaggaggatggggatgttataacttatcagactggcaccagggaacacatgtatgtcacacaaagcacatggacttttggtgtgtagagcacgacagaccaccaccagcaacaccaagaccattaacaacagcagcaaactcaagaacagcagcaacaccagcaacagcaccagcaccatgtcacgcaggattaaatgactcatgtggaggattcttatcaggatgtggaccaatgagattaagacacggagcagacacaagatgtggaagattaatctgtggattatcaacaacagcacagtatccaccaacaagatttggatgtgcaatgagatggggattaccaccatgggaattagtagtattaacagcaagaccagaagacggatggacatgtagaggagtaccagcacacccaggaacaagatgtccagaattagtatcaccaatgggaagagcaacatgttcaccagcatcagcattatggttagcaacagcaaacgcattatcattagatcacgcattagcagcattcgtattattagtaccatgggtattaatattcatggtatgtagaagaacatgtagaagaagaggagcagcagcagcattaacagcagtagtattacagggatataacccaccagcatatggagaggaggcattcacatatttatgtacagcaccaggatgtgcaacacaagcaccagtaccagtaagattagcaggagtaagatttgagtcaaagattgtagacggaggatgttttgcaccatgggacttagaggcaacaggagcatgtatttgtgagatcccaacagatgtatcatgtgagggattaggagcatgggtaccaacagcaccatgtgcaagaatctggaatggaacacagagagcatgtacattctgggcagtaaacgcatattcatcaggaggatatgcacagttagcatcatatttcaacccaggaggatcatattataagcagtatcacccaacagcatgtgaggtagaaccagcattcggacactcagacgcagcatgttggggattcccaacagacacagtaatgtcagtattcgcattagcatcatatgtacagcacccacacaagacagtaagagtaaagttccatacagagacaagaacagtatggcaattatcagtagcaggagtatcatgtaacgtaacaacagaacacccattctgtaacagaccacacggacaattagaggtacaggtaccaccagacccaggagacttagtagagtatattatgaaccacacaggaaatcagcagtcaagatggggattaggatcaccaaattgtcatggaccagattgggcatcaccagtatgtcaaagacattcaccagactgttcaagattagtaggagcaagaccagagagaccaagattaagattagtagacgcagacgacccattattaagaacagcaccaggaccaggagaggtatgggtaagaccagtaataggatcacaggcaagaaagtgtggattacacataagagcaggaccatatggacatgcaacagtagaaatgccagagtggatccacgcacacacaacatcagacccatggcacccaccaggaccattaggattaaagttcaagacagtaagaccagtagcattaccaagaagattagcaccaccaagaaatgtaagagtaacaggatgttatcagtgtggaacaccagcattagtagaaggattagcaccaggaggaggaaattgtcatttaacagtaaatggagaggatttaggagcattcccaccaggaaagttcgtaacagcagcattattaaacacaccaccaccatatcaagtatcatgtggaggagagtcagatagagcatcagcaagagtaattgacccagcagcacaatcatttacaggagtagtatatggaacacacacaacagcagtatcagagacaagacagacatgggcagagtgggcagcagcacattggtggcagttaactttaggagcaatttgtgcattattattagcaggattattagcatgttgtgcaaaatgtttatattatttaagaggagcaatagcaccaagatagtgggcccccgcgcgaaacccgcactagcccactagattcccgcacctgttgctgcatag

SEQ ID NO: 19 - DNA, 2526 bp, Varicella zoster
  CDS (1)..(2526)
atgtttgcgctagttttagcggtggtaattcttcctctttggaccacggctaataaatcttacgtaacaccaacccctgcgactcgctctatcggacatatgtctgctcttctacgagaatattccgaccgtaatatgtctctgaaattagaagccttttatcctactggtttcgatgaagaactcattaaatcacttcactggggaaatgatagaaaacacgttttcttggttattgttaaggttaaccctacaacacacgaaggagacgtcgggctggttatatttccaaaatacttgttatcgccataccatttcaaagcagaacatcgagcaccgtttcctgctggacgttttggatttcttagtcaccctgtgacacccgacgtgagcttctttgacagttcgtttgcgccgtatttaactacgcaacatcttgttgcgtttactacgttcccaccaaacccccttgtatggcatttggaaagagctgagaccgcagcaactgcagaaaggccgtttggggtaagtcttttacccgctcgcccaacagtccccaagaatactattcttgaacataaagcgcattttgctacatgggatgcccttgcccgacatacttttttttctgccgaagcaattatcaccaactcaacgttgagaatacacgttcccctttttgggtcggtatggccaattcgatactgggccaccggttcggtgcttctcacaagcgactcgggtcgtgtggaagtaaatattggtgtaggatttatgagctcgctcatttctttatcctctggactaccgatagaattaattgttgtaccacatacagtaaaactgaacgcggttacaagcgacaccacatggttccagctaaatccaccgggtccggatccggggccatcttatcgagtttatttacttggacgtgggttggatatgaatttttcaaagcatgctacggtcgatatatgcgcatatcccgaagagagtttggattaccgctatcatttatccatggcccacacggaggctctgcggatgacaacgaaggcggatcaacatgacataaacgaggaaagctattaccatatcgccgcaagaatagccacatcaatttttgcgttgtcggaaatgggccgtaccacagaatattttctgttagatgagatcgtagatgttcagtatcaattaaaattccttaattacattttaatgcggataggagcaggagctcatcccaacactatatccggaacctcggatctgatctttgccgatccatcgcagcttcatgacgaactttcacttctttttggtcaggtaaaacccgcaaatgtcgattattttatttcatatgatgaagcccgtgatcaactaaagaccgcatacgcgctttcccgtggtcaagaccatgtgaatgcactttctctcgccaggcgtgttataatgagcatatacaaggggctgcttgtgaagcaaaatttaaatgctacagagaggcaggctttattttttgcctcaatgattttattaaatttccgcgaaggactagaaaattcatctcgggtattagacggtcgcacaactttgcttttaatgacatccatgtgtacggcagctcacgccacgcaagcagcacttaacatacaagaaggcctggcatacttaaatccttcaaaacacatgtttacaataccaaacgtatacagtccttgtatgggttcccttcgtacagacctcacggaagagattcatgttatgaatctcctgtcggcaataccaacacgcccaggacttaacgaggtattgcatacccaactagacgaatctgaaatattcgacgcggcatttaaaaccatgatgatttttaccacatggactgccaaagatttgcatatactccacacccatgtaccagaagtatttacgtgtcaagatgcagccgcgcgtaacggagaatatgtgctcattcttccagctgtccagggacacagttatgtgattacacgaaacaaacctcaaaggggtttggtatattccctggcagatgtggatgtatataaccccatatccgttgtttatttaagcaaggatacttgcgtgtctgaacatggtgtcatagagacggtcgcactgccccatccggacaatttaaaagaatgtttgtattgcggaagtgtttttcttaggtatctaaccacgggggcgattatggatataattattattgacagcaaagatacagaacgacaactagccgctatgggaaactccacaattccacccttcaatccagacatgcacggggatgactctaaggctgtgttgttgtttccaaacggaactgtggtaacgcttctaggattcgaacgacgacaagccatacgaatgtcgggacaataccttggggcctctttaggaggggcgtttctggcggtagtggggtttggtattatcggatggatgttatgtggaaattcccgccttcgagaatataataaaatacctctgacataa

SEQ ID NO: 20 - protein, 841 aa, Varicella zoster
MFALVLAVVILPLWTTANKSYVTPTPATRSIGHMSALLREYSDRNMSLKLEAFYPTGFDEELIKSLHWGNDRKHVFLVIVKVNPTTHEGDVGLVIFPKYLLSPYHFKAEHRAPFPAGRFGFLSHPVTPDVSFFDSSFAPYLTTQHLVAFTTFPPNPLVWHLERAETAATAERPFGVSLLPARPTVPKNTILEHKAHFATWDALARHTFFSAEAIITNSTLRIHVPLFGSVWPIRYWATGSVLLTSDSGRVEVNIGVGFMSSLISLSSGLPIELIVVPHTVKLNAVTSDTTWFQLNPPGPDPGPSYRVYLLGRGLDMNFSKHATVDICAYPEESLDYRYHLSMAHTEALRMTTKADQHDINEESYYHIAARIATSIFALSEMGRTTEYFLLDEIVDVQYQLKFLNYILMRIGAGAHPNTISGTSDLIFADPSQLHDELSLLFGQVKPANVDYFISYDEARDQLKTAYALSRGQDHVNALSLARRVIMSIYKGLLVKQNLNATERQALFFASMILLNFREGLENSSRVLDGRTTLLLMTSMCTAAHATQAALNIQEGLAYLNPSKHMFTIPNVYSPCMGSLRTDLTEEIHVMNLLSAIPTRPGLNEVLHTQLDESEIFDAAFKTMMIFTTWTAKDLHILHTHVPEVFTCQDAAARNGEYVLILPAVQGHSYVITRNKPQRGLVYSLADVDVYNPISVVYLSKDTCVSEHGVIETVALPHPDNLKECLYCGSVFLRYLTTGAIMDIIIIDSKDTERQLAAMGNSTIPPFNPDMHGDDSKAVLLFPNGTVVTLLGFERRQAIRMSGQYLGASLGGAFLAVVGFGIIGWMLCGNSRLREYNKIPLT

SEQ ID NO: 21 - DNA, 2526 bp, Artificial
  deoptimized VZV gH sequence
atgtttgctctagtcctagctgtcgtcatcctacctctatggactactgctaataaaagttacgtcactcctactcctgctactaggagtatcggccatatgagtgctctactaagggaatatagtgacaggaatatgagtctaaaactagaagctttttatcctactggcttcgatgaagaactaatcaaaagtctacactggggcaatgataggaaacacgtcttcctagtcatcgtcaaggtcaaccctactactcacgaaggcgacgtcggcctagtcatctttcctaaatacctactaagtccttaccatttcaaagctgaacatagggctccttttcctgctggcaggtttggctttctaagtcaccctgtcactcctgacgtcagtttctttgacagtagttttgctccttatctaactactcaacatctagtcgcttttactactttccctcctaaccctctagtctggcatctagaaagggctgagactgctgctactgctgaaaggccttttggcgtcagtctactacctgctaggcctactgtccctaagaatactatcctagaacataaagctcattttgctacttgggatgctctagctaggcatactttttttagtgctgaagctatcatcactaacagtactctaaggatccacgtccctctatttggcagtgtctggcctatcaggtactgggctactggcagtgtcctactaactagtgacagtggcagggtcgaagtcaatatcggcgtcggctttatgagtagtctaatcagtctaagtagtggcctacctatcgaactaatcgtcgtccctcatactgtcaaactaaacgctgtcactagtgacactacttggttccagctaaatcctcctggccctgatcctggccctagttatagggtctatctactaggcaggggcctagatatgaattttagtaagcatgctactgtcgatatctgcgcttatcctgaagagagtctagattacaggtatcatctaagtatggctcacactgaggctctaaggatgactactaaggctgatcaacatgacatcaacgaggaaagttattaccatatcgctgctaggatcgctactagtatctttgctctaagtgaaatgggcaggactactgaatattttctactagatgagatcgtcgatgtccagtatcaactaaaattcctaaattacatcctaatgaggatcggcgctggcgctcatcctaacactatcagtggcactagtgatctaatctttgctgatcctagtcagctacatgacgaactaagtctactatttggccaggtcaaacctgctaatgtcgattattttatcagttatgatgaagctagggatcaactaaagactgcttacgctctaagtaggggccaagaccatgtcaatgctctaagtctagctaggagggtcatcatgagtatctacaagggcctactagtcaagcaaaatctaaatgctactgagaggcaggctctattttttgctagtatgatcctactaaatttcagggaaggcctagaaaatagtagtagggtcctagacggcaggactactctactactaatgactagtatgtgtactgctgctcacgctactcaagctgctctaaacatccaagaaggcctagcttacctaaatcctagtaaacacatgtttactatccctaacgtctacagtccttgtatgggcagtctaaggactgacctaactgaagagatccatgtcatgaatctactaagtgctatccctactaggcctggcctaaacgaggtcctacatactcaactagacgaaagtgaaatcttcgacgctgcttttaaaactatgatgatctttactacttggactgctaaagatctacatatcctacacactcatgtccctgaagtctttacttgtcaagatgctgctgctaggaacggcgaatatgtcctaatcctacctgctgtccagggccacagttatgtcatcactaggaacaaacctcaaaggggcctagtctatagtctagctgatgtcgatgtctataaccctatcagtgtcgtctatctaagtaaggatacttgcgtcagtgaacatggcgtcatcgagactgtcgctctacctcatcctgacaatctaaaagaatgtctatattgcggcagtgtctttctaaggtatctaactactggcgctatcatggatatcatcatcatcgacagtaaagatactgaaaggcaactagctgctatgggcaacagtactatccctcctttcaatcctgacatgcacggcgatgacagtaaggctgtcctactatttcctaacggcactgtcgtcactctactaggcttcgaaaggaggcaagctatcaggatgagtggccaatacctaggcgctagtctaggcggcgcttttctagctgtcgtcggctttggcatcatcggctggatgctatgtggcaatagtaggctaagggaatataataaaatccctctaacttaa

SEQ ID NO: 22 - DNA, 1872 bp, Varicella zoster
  CDS (1)..(1872)
atggggacagttaataaacctgtggtgggggtattgatggggttcggaattatcacgggaacgttgcgtataacgaatccggtcagagcatccgtcttgcgatacgatgattttcacatcgatgaagacaaactggatacaaactccgtatatgagccttactaccattcagatcatgcggagtcttcatgggtaaatcggggagagtcttcgcgaaaagcgtacgatcataactcaccttatatatggccacgtaatgattatgatggatttttagagaacgcacacgaacaccatggggtgtataatcagggccgtggtatcgatagcggggaacggttaatgcaacccacacaaatgtctgcacaggaggatcttggggacgatacgggcatccacgttatccctacgttaaacggcgatgacagacataaaattgtaaatgtggaccaacgtcaatacggtgacgtgtttaaaggagatcttaatccaaaaccccaaggccaaagactcattgaggtgtcagtggaagaaaatcacccgtttactttacgcgcaccgattcagcggatttatggagtccggtacaccgagacttggagctttttgccgtcattaacctgtacgggagacgcagcgcccgccatccagcatatatgtttaaaacatacaacatgctttcaagacgtggtggtggatgtggattgcgcggaaaatactaaagaggatcagttggccgaaatcagttaccgttttcaaggtaagaaggaagcggaccaaccgtggattgttgtaaacacgagcacactgtttgatgaactcgaattagacccccccgagattgaaccgggtgtcttgaaagtacttcggacagaaaaacaatacttgggtgtgtacatttggaacatgcgcggctccgatggtacgtctacctacgccacgtttttggtcacctggaaaggggatgaaaaaacaagaaaccctacgcccgcagtaactcctcaaccaagaggggctgagtttcatatgtggaattaccactcgcatgtattttcagttggtgatacgtttagcttggcaatgcatcttcagtataagatacatgaagcgccatttgatttgctgttagagtggttgtatgtccccatcgatcctacatgtcaaccaatgcggttatattctacgtgtttgtatcatcccaacgcaccccaatgcctctctcatatgaattccggttgtacatttacctcgccacatttagcccagcgtgttgcaagcacagtgtatcaaaattgtgaacatgcagataactacaccgcatattgtctgggaatatctcatatggagcctagctttggtctaatcttacacgacgggggcaccacgttaaagtttgtagatacacccgagagtttgtcgggattatacgtttttgtggtgtattttaacgggcatgttgaagccgtagcatacactgttgtatccacagtagatcattttgtaaacgcaattgaagagcgtggatttccgccaacggccggtcagccaccggcgactactaaacccaaggaaattacccccgtaaaccccggaacgtcaccacttctacgatatgccgcatggaccggagggcttgcagcagtagtacttttatgtctcgtaatatttttaatctgtacggctaaacgaatgagggttaaagcctatagggtagacaagtccccgtataaccaaagcatgtattacgctggccttccagtggacgatttcgaggactcggaatctacggatacggaagaagagtttggtaacgcgattggagggagtcacgggggttcgagttacacggtgtatatagataagacccggtga

SEQ ID NO: 23 - protein, 623 aa, Varicella zoster
MGTVNKPVVGVLMGFGIITGTLRITNPVRASVLRYDDFHIDEDKLDTNSVYEPYYHSDHAESSWVNRGESSRKAYDHNSPYIWPRNDYDGFLENAHEHHGVYNQGRGIDSGERLMQPTQMSAQEDLGDDTGIHVIPTLNGDDRHKIVNVDQRQYGDVFKGDLNPKPQGQRLIEVSVEENHPFTLRAPIQRIYGVRYTETWSFLPSLTCTGDAAPAIQHICLKHTTCFQDVVVDVDCAENTKEDQLAEISYRFQGKKEADQPWIVVNTSTLFDELELDPPEIEPGVLKVLRTEKQYLGVYIWNMRGSDGTSTYATFLVTWKGDEKTRNPTPAVTPQPRGAEFHMWNYHSHVFSVGDTFSLAMHLQYKIHEAPFDLLLEWLYVPIDPTCQPMRLYSTCLYHPNAPQCLSHMNSGCTFTSPHLAQRVASTVYQNCEHADNYTAYCLGISHMEPSFGLILHDGGTTLKFVDTPESLSGLYVFVVYFNGHVEAVAYTVVSTVDHFVNAIEERGFPPTAGQPPATTKPKEITPVNPGTSPLLRYAAWTGGLAAVVLLCLVIFLICTAKRMRVKAYRVDKSPYNQSMYYAGLPVDDFEDSESTDTEEEFGNAIGGSHGGSSYTVYIDKTR

SEQ ID NO: 24 - DNA, 1872 bp, Artificial
  deoptimized VZV gE sequence
atgggcactgtcaataaacctgtcgtcggcgtcctaatgggcttcggcatcatcactggcactctaaggatcactaatcctgtcagggctagtgtcctaaggtacgatgattttcacatcgatgaagacaaactagatactaacagtgtctatgagccttactaccatagtgatcatgctgagagtagttgggtcaataggggcgagagtagtaggaaagcttacgatcataacagtccttatatctggcctaggaatgattatgatggctttctagagaacgctcacgaacaccatggcgtctataatcagggcaggggcatcgatagtggcgaaaggctaatgcaacctactcaaatgagtgctcaggaggatctaggcgacgatactggcatccacgtcatccctactctaaacggcgatgacaggcataaaatcgtcaatgtcgaccaaaggcaatacggcgacgtctttaaaggcgatctaaatcctaaacctcaaggccaaaggctaatcgaggtcagtgtcgaagaaaatcacccttttactctaagggctcctatccagaggatctatggcgtcaggtacactgagacttggagttttctacctagtctaacttgtactggcgacgctgctcctgctatccagcatatctgtctaaaacatactacttgctttcaagacgtcgtcgtcgatgtcgattgcgctgaaaatactaaagaggatcagctagctgaaatcagttacaggtttcaaggcaagaaggaagctgaccaaccttggatcgtcgtcaacactagtactctatttgatgaactagaactagaccctcctgagatcgaacctggcgtcctaaaagtcctaaggactgaaaaacaatacctaggcgtctacatctggaacatgaggggcagtgatggcactagtacttacgctacttttctagtcacttggaaaggcgatgaaaaaactaggaaccctactcctgctgtcactcctcaacctaggggcgctgagtttcatatgtggaattaccacagtcatgtctttagtgtcggcgatacttttagtctagctatgcatctacagtataagatccatgaagctccttttgatctactactagagtggctatatgtccctatcgatcctacttgtcaacctatgaggctatatagtacttgtctatatcatcctaacgctcctcaatgcctaagtcatatgaatagtggctgtacttttactagtcctcatctagctcagagggtcgctagtactgtctatcaaaattgtgaacatgctgataactacactgcttattgtctaggcatcagtcatatggagcctagttttggcctaatcctacacgacggcggcactactctaaagtttgtcgatactcctgagagtctaagtggcctatacgtctttgtcgtctattttaacggccatgtcgaagctgtcgcttacactgtcgtcagtactgtcgatcattttgtcaacgctatcgaagagaggggctttcctcctactgctggccagcctcctgctactactaaacctaaggaaatcactcctgtcaaccctggcactagtcctctactaaggtatgctgcttggactggcggcctagctgctgtcgtcctactatgtctagtcatctttctaatctgtactgctaaaaggatgagggtcaaagcttatagggtcgacaagagtccttataaccaaagtatgtattacgctggcctacctgtcgacgatttcgaggacagtgaaagtactgatactgaagaagagtttggcaacgctatcggcggcagtcacggcggcagtagttacactgtctatatcgataagactaggtga

SEQ ID NO: 25 - DNA, 2373 bp, Measles virus strain Moraten
  CDS (575)..(2236)
agggccaaggaacatacacacccaacagaacccagaccccggcccacggcgccgcgcccccaacccccgacaaccagagggagcccccaaccaatcccgccggctcccccggtgcccacaggcagggacaccaacccccgaacagacccagcacccaaccatcgacaatccaagacgggggggcccccccaaaaaaaggcccccaggggccgacagccagcaccgcgaggaagcccacccaccccacacacgaccacggcaaccaaaccagaacccagaccaccctgggccaccagctcccagactcggccatcaccccgcagaaaggaaaggccacaacccgcgcaccccagccccgatccggcggggagccacccaacccgaaccagcacccaagagcgatccccgaaggacccccgaaccgcaaaggacatcagtatcccacagcctctccaagtcccccggtctcctcctcttctcgaagggaccaaaagatcaatccaccacacccgacgacactcaactccccacccctaaaggagacaccgggaatcccagaatcaagactcatccaatgtccatcatgggtctcaaggtgaacgtctctgccatattcatggcagtactgttaactctccaaacacccaccggtcaaatccattggggcaatctctctaagataggggtggtaggaataggaagtgcaagctacaaagttatgactcgttccagccatcaatcattagtcataaaattaatgcccaatataactctcctcaataactgcacgagggtagagattgcagaatacaggagactactgagaacagttttggaaccaattagagatgcacttaatgcaatgacccagaatataagaccggttcagagtgtagcttcaagtaggagacacaagagatttgcgggagtagtcctggcaggtgcggccctaggcgttgccacagctgctcagataacagccggcattgcacttcaccagtccatgctgaactctcaagccatcgacaatctgagagcgagcctggaaactactaatcaggcaattgagacaatcagacaagcagggcaggagatgatattggctgttcagggtgtccaagactacatcaataatgagctgataccgtctatgaaccaactatcttgtgatttaatcggccagaagctcgggctcaaattgctcagatactatacagaaatcctgtcattatttggccccagtttacgggaccccatatctgcggagatatctatccaggctttgagctatgcgcttggaggagacatcaataaggtgttagaaaagctcggatacagtggaggtgatttactgggcatcttagagagcggaggaataaaggcccggataactcacgtcgacacagagtcctacttcattgtcctcagtatagcctatccgacgctgtccgagattaagggggtgattgtccaccggctagagggggtctcgtacaacataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtacaccaagtcctgtgctcgtacactcgtatccgggtcttttgggaaccggttcattttatcacaagggaacctaatagccaattgtgcatcaatcctttgcaagtgttacacaacaggaacgatcattaatcaagaccctgacaagatcctaacatacattgctgccgatcactgcccggtagtcgaggtgaacggcgtgaccatccaagtcgggagcaggaggtatccagacgctgtgtacttgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtctacatcctgattgcagtgtgtcttggagggttgatagggatccccgctttaatatgttgctgcagggggcgttgtaacaaaaagggagaacaagttggtatgtcaagaccaggcctaaagcctgatcttacgggaacatcaaaatcctatgtaaggtcgctctgatcctctacaactcttgaaacacaaatgtcccacaagtctcctcttcgtcatcaagcaaccaccgcacccagcatcaagcccacctgaaattatctccggcttccctctggccgaacaatatcggtagttaatcaaaa

SEQ ID NO: 26 - protein, 553 aa, Measles virus strain Moraten
MSIMGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIETIRQAGQEMILAVQGVQDYINNELIPSMNQLSCDLIGQKLGLKLLRYYTEILSLFGPSLRDPISAEISIQALSYALGGDINKVLEKLGYSGGDLLGILESGGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGYTKSCARTLVSGSFGNRFILSQGNLIANCASILCKCYTTGTIINQDPDKILTYIAADHCPVVEVNGVTIQVGSRRYPDAVYLHRIDLGPPISLERLDVGTNLGNAIAKLEDAKELLESSDQILRSMKGLSSTSIVYILIAVCLGGLIGIPALICCCRGRCNKKGEQVGMSRPGLKPDLTGTSKSYVRSL

SEQ ID NO: 27 - DNA, 2373 bp, Artificial
  deoptimized measles F sequence
agggccaaggaacatacacacccaacagaacccagaccccggcccacggcgccgcgcccccaacccccgacaaccagagggagcccccaaccaatcccgccggctcccccggtgcccacaggcagggacaccaacccccgaacagacccagcacccaaccatcgacaatccaagacgggggggcccccccaaaaaaaggcccccaggggccgacagccagcaccgcgaggaagcccacccaccccacacacgaccacggcaaccaaaccagaacccagaccaccctgggccaccagctcccagactcggccatcaccccgcagaaaggaaaggccacaacccgcgcaccccagccccgatccggcggggagccacccaacccgaaccagcacccaagagcgatccccgaaggacccccgaaccgcaaaggacatcagtatcccacagcctctccaagtcccccggtctcctcctcttctcgaagggaccaaaagatcaatccaccacacccgacgacactcaactccccacccctaaaggagacaccgggaatcccagaatcaagactcatccaatgtcgatcatgggccttaaggtaaacgtatcggcgatattcatggcggtacttcttacgcttcaaacgccgacgggccaaatccattggggcaatctttcgaagataggcgtagtaggcataggctcggcgtcgtacaaagtaatgacgcgctcgtcgcatcaatcgcttgtaataaaacttatgccgaatataacgcttcttaataactgcacgcgcgtagagattgcggaataccgccgccttcttcgcacggtacttgaaccgattcgcgatgcgcttaatgcgatgacgcagaatatacgcccggtacagtcggtagcgtcgtcgcgccgccacaagcgctttgcgggcgtagtacttgcgggcgcggcgcttggcgtagcgacggcggcgcagataacggcgggcattgcgcttcaccagtcgatgcttaactcgcaagcgatcgacaatcttcgcgcgtcgcttgaaacgacgaatcaggcgattgagacgatccgccaagcgggccaggagatgatacttgcggtacagggcgtacaagactacatcaataatgagcttataccgtcgatgaaccaactttcgtgtgatcttatcggccagaagcttggccttaaacttcttcgctactatacggaaatcctttcgctttttggcccgtcgcttcgggacccgatatcggcggagatatcgatccaggcgctttcgtatgcgcttggcggcgacatcaataaggtacttgaaaagcttggctactcgggcggcgatcttcttggcatccttgagtcgggcggcataaaggcgcgcataacgcacgtagacacggagtcgtacttcattgtactttcgatagcgtatccgacgctttcggagattaagggcgtaattgtacaccgccttgagggcgtatcgtacaacataggctcgcaagagtggtatacgacggtaccgaagtatgtagcgacgcaaggctaccttatctcgaattttgatgagtcgtcgtgtacgttcatgccggagggcacggtatgctcgcaaaatgcgctttacccgatgtcgccgcttcttcaagaatgccttcgcggctacacgaagtcgtgtgcgcgcacgcttgtatcgggctcgtttggcaaccgcttcattctttcgcaaggcaaccttatagcgaattgtgcgtcgatcctttgcaagtgttacacgacgggcacgatcattaatcaagacccggacaagatccttacgtacattgcggcggatcactgcccggtagtagaggtaaacggcgtaacgatccaagtaggctcgcgccgctatccggacgcggtataccttcaccgcattgaccttggcccgccgatatcgcttgagcgccttgacgtaggcacgaatcttggcaatgcgattgcgaagcttgaggatgcgaaggaacttcttgagtcgtcggaccagatacttcgctcgatgaaaggcctttcgtcgacgtcgatagtatacatccttattgcggtatgtcttggcggccttataggcatcccggcgcttatatgttgctgccgcggccgctgtaacaaaaagggcgaacaagtaggcatgtcgcgcccgggccttaagccggatcttacgggcacgtcgaaatcgtatgtacgctcgctttgatcctctacaactcttgaaacacaaatgtcccacaagtctcctcttcgtcatcaagcaaccaccgcacccagcatcaagcccacctgaaattatctccggcttccctctggccgaacaatatcggtagttaatcaaaa

SEQ ID NO: 28 - DNA, 1958 bp, Measles virus strain Moraten
  CDS (21)..(1874)
agggtgcaagatcatccacaatgtcaccacaacgagaccggataaatgccttctacaaagataacccccatcccaagggaagtaggatagtcattaacagagaacatcttatgattgatagaccttatgttttgctggctgttctgtttgtcatgtttctgagcttgatcgggttgctagccattgcaggcattagacttcatcgggcagccatctacaccgcagagatccataaaagcctcagcaccaatctagatgtaactaactcaatcgagcatcaggtcaaggacgtgctgacaccactcttcaaaatcatcggtgatgaagtgggcctgaggacacctcagagattcactgacctagtgaaattaatctctgacaagattaaattccttaatccggatagggagtacgacttcagagatctcacttggtgtatcaacccgccagagagaatcaaattggattatgatcaatactgtgcagatgtggctgctgaagagctcatgaatgcattggtgaactcaactctactggagaccagaacaaccaatcagttcctagctgtctcaaagggaaactgctcagggcccactacaatcagaggtcaattctcaaacatgtcgctgtccctgttagacttgtatttaggtcgaggttacaatgtgtcatctatagtcactatgacatcccagggaatgtatgggggaacttacctagtggaaaagcctaatctgagcagcaaaaggtcagagttgtcacaactgagcatgtaccgagtgtttgaagtaggtgttatcagaaatccgggtttgggggctccggtgttccatatgacaaactatcttgagcaaccagtcagtaatgatctcagcaactgtatggtggctttgggggagctcaaactcgcagccctttgtcacggggaagattctatcacaattccctatcagggatcagggaaaggtgtcagcttccagctcgtcaagctaggtgtctggaaatccccaaccgacatgcaatcctgggtccccttatcaacggatgatccagtgatagacaggctttacctctcatctcacagaggtgttatcgctgacaatcaagcaaaatgggctgtcccgacaacacgaacagatgacaagttgcgaatggagacatgcttccaacaggcgtgtaagggtaaaatccaagcactctgcgagaatcccgagtgggcaccattgaaggataacaggattccttcatacggggtcttgtctgttgatctgagtctgacagttgagcttaaaatcaaaattgcttcgggattcgggccattgatcacacacggttcagggatggacctatacaaatccaaccacaacaatgtgtattggctgactatcccgccaatgaagaacctagccttaggtgtaatcaacacattggagtggataccgagattcaaggttagtccctacctcttcactgtcccaattaaggaagcaggcgaagactgccatgccccaacatacctacctgcggaggtggatggtgatgtcaaactcagttccaatctggtgattctacctggtcaagatctccaatatgttttggcaacctacgatacttccagggttgaacatgctgtggtttattacgtttacagcccaagccgctcattttcttacttttatccttttaggttgcctataaagggggtccccatcgaattacaagtggaatgcttcacatgggaccaaaaactctggtgccgtcacttctgtgtgcttgcggactcagaatctggtggacatatcactcactctgggatggtgggcatgggagtcagctgcacagtcacccgggaagatggaaccaatcgcagatagggctgctagtgaaccaatcacatgatgtcacccagacatcaggcatacccactagtgtgaaatagacatcagaattaagaaaaa

SEQ ID NO: 29 - protein, 617 aa, Measles virus strain Moraten
MSPQRDRINAFYKDNPHPKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKLISDKIKFLNPDREYDFRDLTWCINPPERIKLDYDQYCADVAAEELMNALVNSTLLETRTTNQFLAVSKGNCSGPTTIRGQFSNMSLSLLDLYLGRGYNVSSIVTMTSQGMYGGTYLVEKPNLSSKRSELSQLSMYRVFEVGVIRNPGLGAPVFHMTNYLEQPVSNDLSNCMVALGELKLAALCHGEDSITIPYQGSGKGVSFQLVKLGVWKSPTDMQSWVPLSTDDPVIDRLYLSSHRGVIADNQAKWAVPTTRTDDKLRMETCFQQACKGKIQALCENPEWAPLKDNRIPSYGVLSVDLSLTVELKIKIASGFGPLITHGSGMDLYKSNHNNVYWLTIPPMKNLALGVINTLEWIPRFKVSPYLFTVPIKEAGEDCHAPTYLPAEVDGDVKLSSNLVILPGQDLQYVLATYDTSRVEHAVVYYVYSPSRSFSYFYPFRLPIKGVPIELQVECFTWDQKLWCRHFCVLADSESGGHITHSGMVGMGVSCTVTREDGTNRR

SEQ ID NO: 30 - DNA, 1958 bp, Artificial
  deoptimized measles H sequence.
agggtgcaagatcatccacaatgtcgccgcaacgcgaccgcataaatgcgttctacaaagataacccgcatccgaagggctcgcgcatagtaattaaccgcgaacatcttatgattgatcgcccgtatgtacttcttgcggtactttttgtaatgtttctttcgcttatcggccttcttgcgattgcgggcattcgccttcatcgcgcggcgatctacaccgcggagatccataaatcgctctcgacgaatcttgatgtaacgaactcgatcgagcatcaggtaaaggacgtacttacgccgcttttcaaaatcatcggcgatgaagtaggccttcgcacgccgcagcgcttcacggaccttgtaaaacttatctcggacaagattaaattccttaatccggatcgcgagtacgacttccgcgatcttacgtggtgtatcaacccgccggagcgcatcaaacttgattatgatcaatactgtgcggatgtagcggcggaagagcttatgaatgcgcttgtaaactcgacgcttcttgagacgcgcacgacgaatcagttccttgcggtatcgaagggcaactgctcgggcccgacgacgatccgcggccaattctcgaacatgtcgctttcgcttcttgacctttatcttggccgcggctacaatgtatcgtcgatagtaacgatgacgtcccagggcatgtatggcggcacgtaccttgtagaaaagccgaatctttcgtcgaaacgctcggagctttcgcaactttcgatgtaccgcgtatttgaagtaggcgtaatccgcaatccgggccttggcgcgccggtattccatatgacgaactatcttgagcaaccggtatcgaatgatctttcgaactgtatggtagcgcttggcgagcttaaacttgcggcgctttgtcacggcgaagattcgatcacgattccgtatcagggctcgggcaaaggcgtatcgttccagcttgtaaagcttggcgtatggaaatcgccgacggacatgcaatcgtgggtaccgctttcgacggatgatccggtaatagaccgcctttacctttcgtcgcaccgcggcgtaatcgcggacaatcaagcgaaatgggcggtaccgacgacgcgcacggatgacaagcttcgcatggagacgtgcttccaacaggcgtgtaagggcaaaatccaagcgctttgcgagaatccggagtgggcgccgcttaaggataaccgcattccgtcgtacggcgtactttcggtagatctttcgcttacggtagagcttaaaatcaaaattgcgtcgggcttcggcccgcttatcacgcacggctcgggcatggacctttacaaatcgaaccacaacaatgtatattggcttacgatcccgccgatgaagaaccttgcgcttggcgtaatcaacacgcttgagtggataccgcgcttcaaggtatcgccgtaccttttcacggtaccgattaaggaagcgggcgaagactgccatgcgccgacgtaccttccggcggaggtagatggcgatgtaaaactttcgtcgaatcttgtaattcttccgggccaagatcttcaatatgtacttgcgacgtacgatacgtcgcgcgtagaacatgcggtagtatattacgtatactcgccgtcgcgctcgttttcgtacttttatccgtttcgccttccgataaagggcgtaccgatcgaacttcaagtagaatgcttcacgtgggaccaaaaactttggtgccgccacttctgtgtacttgcggactcggaatcgggcggccatatcacgcactcgggcatggtaggcatgggcgtatcgtgcacggtaacgcgcgaagatggcacgaatcgccgctagggctgctagtgaaccaatcacatgatgtcacccagacatcaggcatacccactagtgtgaaatagacatcagaattaagaaaaa

SEQ ID NO: 31 - DNA, 1903 bp, Human respiratory syncytial virus
  CDS (14)..(1738)
ggggcaaataacaatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagcaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccataaatatcatgataactactataattatagtgattatagtaatattgttatcattaattgctgttggactgctcttatactgtaaggccagaagcacaccagtcacactaagcaaagatcaactgagtggtataaataatattgcatttagtaactaaataaaaatagcacctaatcatgttcttacaatggtttactatctgctcatagacaacccatctgtcattggattttcttaaaatctgaacttcatcgaaactctcatctataaaccatctcacttacactatttaagtagattcctagtttatagttatataaaa

SEQ ID NO: 32 - protein, 574 aa, Human respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 33 - DNA, 1903 bp, Artificial
  deoptimized RSV F sequence
ggggcaaataacaatggagctgctgatcctgaaagcgaatgcgattaccacgatcctgacggcggtcacgttttgttttgcgtcggggcaaaacatcacggaggagttttatcaatcgacgtgctcggcggtttcgaaagggtatctgtcggcgctgcggacggggtggtatacctcggttataacgatagagctgtcgaatatcaaggagaataagtgtaatgggacggatgcgaaggtaaaactgataaaacaagagctggataaatataaaaatgcggtaacggagctgcagctgctgatgcaatcgacgccggcgacgaacaatcgggcgcggcgggagctgccgaggtttatgaattatacgctgaacaatgcgaaaaaaacgaatgtaacgctgtcgaagaaaaggaaacggcggtttctggggtttctgctgggggttgggtcggcgatcgcgtcgggggttgcggtatcgaaggtcctgcacctggagggggaggtgaacaagatcaaatcggcgctgctgtccacgaacaaggcggtagtctcgctgtcgaatggggtttcggtcctgacgtcgaaagtgctggacctgaaaaactatatagataaacaactgctgccgattgtgaacaagcaatcgtgctcgatatcgaatatagcgacggtgatagagttccaacaaaagaacaaccggctgctggagattacgcgggagttttcggttaatgcgggggtaacgacgccggtatcgacgtacatgctgacgaattcggagctgctgtcgctgatcaatgatatgccgataacgaatgatcagaaaaagctgatgtcgaacaatgttcaaatagttcggcagcaatcgtactcgatcatgtcgataataaaagaggaggtcctggcgtatgtagtacaactgccgctgtatggggttatagatacgccgtgttggaaactgcacacgtcgccgctgtgtacgacgaacacgaaagaggggtcgaacatctgtctgacgcggacggaccgggggtggtactgtgacaatgcggggtcggtatcgttcttcccgcaagcggagacgtgtaaagttcaatcgaatcgggtattttgtgacacgatgaactcgctgacgctgccgtcggaggtaaatctgtgcaatgttgacatattcaacccgaaatatgattgtaaaattatgacgtcgaaaacggatgtatcgtcgtcggttatcacgtcgctgggggcgattgtgtcgtgctatgggaaaacgaaatgtacggcgtcgaataaaaatcgggggatcataaagacgttttcgaacgggtgcgattatgtatcgaataaaggggtggacacggtgtcggtagggaacacgctgtattatgtaaataagcaagaggggaaatcgctgtatgtaaaaggggagccgataataaatttctatgacccgctggtattcccgtcggatgagtttgatgcgtcgatatcgcaagtcaacgagaagattaaccagtcgctggcgtttattcggaaatcggatgagctgctgcataatgtaaatgcggggaaatcgacgataaatatcatgataacgacgataattatagtgattatagtaatactgctgtcgctgattgcggttgggctgctgctgtactgtaaggcccggtcgacgccggtcacgctgtcgaaagatcaactgtcggggataaataatattgcgttttcgaactaaataaaaatagcgcctaatcatgttctgacgatggtttactatctgctgatagacaacccatcggtcattggattttcttaaaatctgaacttcatcgaaactctcatctataaaccatctcacttacactatttaagtagattcctagtttatagttatataaaa

SEQ ID NO: 34 - DNA, 1903 bp, Human respiratory syncytial virus; identical to SEQ ID NO: 33
  CDS (14)..(1735)

SEQ ID NO: 35 - protein, 574 aa, Human respiratory syncytial virus; identical to SEQ ID NO: 32

SEQ ID NO: 36 - DNA, 923 bp, Artificial
  deoptimized RSV G sequence
ggggcgaatgcgaacatgtcgaaaaacaaggaccaacggacggcgaagacgctggagcggacgtgggacacgctgaatcatctgctgttcatatcgtcgtgcctgtataagctgaatctgaaatcggtagcgcaaatcacgctgtcgattctggcgatgataatctcgacgtcgctgataattgcggcgatcatattcatagcgtcggcgaaccacaaagtcacgccgacgacggcgatcatacaagatgcgacgtcgcagatcaagaacacgacgccgacgtacctgacgcagaatccgcagctggggatctcgccgtcgaatccgtcggagattacgtcgcaaatcacgacgatactggcgtcgacgacgccgggggtcaagtcgacgctgcaatcgacgacggtcaagacgaaaaacacgacgacgacgcaaacgcaaccgtcgaagccgacgacgaaacaacggcaaaacaaaccgccgtcgaaaccgaataatgattttcactttgaggtgttcaactttgtaccgtgctcgatatgctcgaacaatccgacgtgctgggcgatctgcaaacggataccgaacaaaaaaccggggaagaaaacgacgacgaagccgacgaaaaaaccgacgctgaagacgacgaaaaaagatccgaaaccgcaaacgacgaaatcgaaggaggtaccgacgacgaagccgacggaggagccgacgatcaacacgacgaaaacgaacatcataacgacgctgctgacgtcgaacacgacggggaatccggagctgacgtcgcaaatggagacgttccactcgacgtcgtcggaggggaatccgtcgccgtcgcaagtctcgacgacgtcggagtacccgtcgcaaccgtcgtcgccgccgaacacgccgcggcagtagctgctgaaaaa

SEQ ID NO: 37 - DNA, 1042 bp, Influenza A virus
  CDS (1)..(1041)
caaaaacttcccggaaatgacaacagcacggcaacgctgtgccttgggcaccatgcagtaccaaacggaacgattgtgaaaacaatcacgaatgaccaaattgaagttactaatgctactgagctggttcagagttcctcaacaggtggaatatgcgacagtcctcatcagatccttgatggagaaaactgcacactaatagatgctctattgggagaccctcagtgtgatggcttccaaaataagaaatgggacctttttgttgaacgcagcaaagcctacagcaactgttacccttatgatgtgccggattatgcctcccttaggtcactagttgcctcatccggcacactggagtttaacaatgaaagcttcaattggactggagtcactcagaatggaacaagctctgcttgcaaaaggagatctaataaaagtttctttagtagattgaattggttgacccatttaaaatacaaatacccagcattgaacgtgactatgccaaacaatgaaaaatttgacaaattgtacatttggggggttcaccacccgggtacggacagtgaccaaatcagcctatatgctcaagcatcaggaagaatcacagtctctaccaaaagaagccaacaaactgtaatcccgaatatcggatctagacccagggtaagggatgtctccagcagaataagcatctattggacaatagtaaaaccgggagacatacttttgattaacagcacagggaatctaattgctcctaggggttacttcaaaatacgaagtgggaaaagctcaataatgagatcagatgcacccattggcaaatgcaattctgaatgcatcactccaaatggaagcattcccaatgacaaaccatttcaaaatgtaaacaggatcacatatggggcctgtcccagatatgttaagcaaaacactctgaaattggcaacagggatgcgaaatgtaccagagaaacaaactagaggcatatttggcgcaatcgcgggtttcatagaaaatggttgggagggaatggtgg

SEQ ID NO: 38 - protein, 347 aa, Influenza A virus
QKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMV

SEQ ID NO: 39 - DNA, 1042 bp, Artificial
  deoptimized influenza HA sequence
caaaaattaccgggcaatgacaactcgacggcgacgttatgcttaggccaccatgcggtaccgaacggcacgatcgtgaaaacgatcacgaatgaccaaatcgaagttacgaatgctacggagttagttcagtcgtcgtcgacgggcggcatctgcgactcgccgcatcagatcttagatggcgaaaactgcacgttaatcgatgctttattaggcgacccgcagtgtgatggcttccaaaataagaaatgggacttatttgttgaacgctcgaaagcgtactcgaactgttacccgtatgatgtgccggattatgcgtcgttacgctcgttagttgcgtcgtcgggcacgttagagtttaacaatgaatcgttcaattggacgggcgtcacgcagaatggcacgtcgtcggcttgcaaacgccgctcgaataaatcgttcttttcgcgcttaaattggttaacgcatttaaaatacaaatacccggcgttaaacgtgacgatgccgaacaatgaaaaatttgacaaattatacatctggggcgttcaccacccgggcacggactcggaccaaatctcgttatatgctcaagcgtcgggccgcatcacggtctcgacgaaacgctcgcaacaaacggtaatcccgaatatcggctcgcgcccgcgcgtacgcgatgtctcgtcgcgcatctcgatctattggacgatcgtaaaaccgggcgacatcttattaatcaactcgacgggcaatttaatcgctccgcgcggctacttcaaaatccgctcgggcaaatcgtcgatcatgcgctcggatgcgccgatcggcaaatgcaattcggaatgcatcacgccgaatggctcgatcccgaatgacaaaccgtttcaaaatgtaaaccgcatcacgtatggcgcgtgtccgcgctatgttaagcaaaacacgttaaaattagcgacgggcatgcgcaatgtaccggagaaacaaacgcgcggcatctttggcgcgatcgcgggcttcatcgaaaatggctgggagggcatggtgg

SEQ ID NO: 40 - DNA, 1459 bp, Influenza virus
  CDS (1)..(1425)
  misc_feature (15)..(15): n is a, c, g, or t
aaagcaggagtgaanatgaatccaaatcaaaagataataacgattggctctgtttctctcaccatttccacaatatgcttcttcatgcaaattgccatcctgataactactgtaacattgcatttcaagcaatatgaattcaactcccccccaaacaaccaagtgatgctgtgtgaaccaacaataatagaaagaaacataacagagatagtgtatctgaccaacaccaccatagagaaggaaatatgccccaaactagcagaatacagaaattggtcaaagccgcaatgtaacattacaggatttgcacctttttctaaggacaattcgattcggctttccgctggtggggacatctgggtgacaagagaaccttatgtgtcatgcgatcctgacaagtgttatcaatttgcccttggacagggaacaacactaaacaacgtgcattcaaatgacacagtacatgataggaccccttatcggaccctattgatgaatgagttgggtgttccatttcatctggggaccaagcaagtgtgcatagcatggtccagctcaagttgtcacgatggaaaggcatggctgcatgtttgtgtaacgggggatgatgaaaatgcaactgctagcttcatttacaatgggaggcttgtagatagtattgtttcatggtccaaaaaaatcctcaggacccaggagtcagaatgcgtttgtatcaatggaacttgtacagtagtaatgactgatgggagtgcttcaggaaaagctgatactaaaatactattcattgaggaggggaaaatcgttcatactagcacattgtcaggaagtgctcagcatgtcgaggagtgctcctgttatcctcgatatcctggtgtcagatgtgtctgcagagacaactggaaaggctccaataggcccatcgtagatataaacataaaggattatagcattgtttccagttatgtgtgctcaggacttgttggagacacacccagaaaaaacgacagctccagcagtagccattgcttggatccaaacaatgaggaaggtggtcatggagtgaaaggctgggcctttgatgatggaaatgacgtgtggatgggaagaacgatcagcgagaagttacgctcaggatatgaaaccttcaaagtcattgaaggctggtccaaccctaactccaaattgcagataaataggcaagtcatagttgacagaggtaataggtccggttattctggtattttctctgttgaaggcaaaagctgcatcaatcggtgcttttatgtggagttgataaggggaagaaaacaagaaactgaagtcttgtggacctcaaacagtattgttgtgttttgtggcacctcaggtacatatggaacaggctcatggcctgatggggcggacatcaatctcatgcctatataagctttcgcaattttagaaaaaactccttgtttcc

SEQ ID NO: 41 - protein, 474 aa, Influenza virus
  misc_feature (5)..(5): The 'Xaa' at location 5 stands for Lys, or Asn.
KAGVXMNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 42 - DNA, 1459 bp, Artificial
  deoptimized influena NA sequence
  misc_feature (15)..(15): n is a, c, g, or t
aaagcgggcgtgaanatgaatccgaatcaaaagatcatcacgatcggctcggtttcgttaacgatctcgacgatctgcttcttcatgcaaatcgcgatcttaatcacgacggtaacgttacatttcaagcaatatgaattcaactcgccgccgaacaaccaagtgatgttatgtgaaccgacgatcatcgaacgcaacatcacggagatcgtgtatttaacgaacacgacgatcgagaaggaaatctgcccgaaattagcggaataccgcaattggtcgaagccgcaatgtaacatcacgggctttgcgccgttttcgaaggacaattcgatccgcttatcggcgggcggcgacatctgggtgacgcgcgaaccgtatgtgtcgtgcgatccggacaagtgttatcaatttgcgttaggccagggcacgacgttaaacaacgtgcattcgaatgacacggtacatgatcgcacgccgtatcgcacgttattaatgaatgagttaggcgttccgtttcatttaggcacgaagcaagtgtgcatcgcgtggtcgtcgtcgtcgtgtcacgatggcaaggcgtggttacatgtttgtgtaacgggcgatgatgaaaatgcgacggcgtcgttcatctacaatggccgcttagtagattcgatcgtttcgtggtcgaaaaaaatcttacgcacgcaggagtcggaatgcgtttgtatcaatggcacgtgtacggtagtaatgacggatggctcggcgtcgggcaaagcggatacgaaaatcttattcatcgaggagggcaaaatcgttcatacgtcgacgttatcgggctcggcgcagcatgtcgaggagtgctcgtgttatccgcgctatccgggcgtccgctgtgtctgccgcgacaactggaaaggctcgaatcgcccgatcgtagatatcaacatcaaggattattcgatcgtttcgtcgtatgtgtgctcgggcttagttggcgacacgccgcgcaaaaacgactcgtcgtcgtcgtcgcattgcttagatccgaacaatgaggaaggcggccatggcgtgaaaggctgggcgtttgatgatggcaatgacgtgtggatgggccgcacgatctcggagaagttacgctcgggctatgaaacgttcaaagtcatcgaaggctggtcgaacccgaactcgaaattacagatcaatcgccaagtcatcgttgaccgcggcaatcgctcgggctattcgggcatcttctcggttgaaggcaaatcgtgcatcaatcgctgcttttatgtggagttaatccgcggccgcaaacaagaaacggaagtcttatggacgtcgaactcgatcgttgtgttttgtggcacgtcgggcacgtatggcacgggctcgtggccggatggcgcggacatcaatttaatgccgatctaagcgttcgcgatcttagaaaaaacgccgtgtttcc

SEQ ID NO: 43 - DNA, 2550 bp, Human immunodeficiency virus type 1
  CDS (1)..(2550)
atgagagtgatggggatattgaagaattatcagcaatggtggatgtggggcatcttaggcttttggatgttaataattagtagtgtggtaggaaacttgtgggtcacagtctattatggggtacctgtgtggaaagaagcaaaaactactctattctgtacatcagatgctaaagcatatgagacagaggtgcataatgtctgggctacacatgcctgtgtacccacagaccccaacccacaagaaatagttttggaaaatgtaacagaaaattttaacatgtggaaaaatgacatggtggatcagatgcatgaggatataatcagtttatgggaccaaagcctaaagccatgtgtaaagttgaccccactctgtgtcactttaaaatgtagaaatgttaatgctaccaacaatattaatagcatgattgataacagtaataagggagaaatgaaaaattgctctttcaatgtaaccacagaactaagagataggaaacaggaagtacatgcacttttttatagacttgatgtagtaccacttcagggcaacaactctaatgagtatagattaataaattgtaatacgtcagccataacacaagcctgtccaaaggtctcttttgatccaattcctatacattattgtactccagctggttatgcgattctaaagtgtaataatcagacattcaatgggacaggaccatgcaataatgtcagctcagtacaatgtgcacatggaattaagccagtggtatcaactcagctactgttaaatggtagcgtagcaaaaggagagataataattagatctgaaaatctgacaaacaatgccaaaataataatagtacaacttaataaacctgtaaaaattgtgtgtgtaaggcctaacaataatacaagaaaaagtgtaaggataggaccaggacaaacattctatgcaacaggagaaataataggagacataagacaagcatattgtatcattaataaaactgaatggaatagcactttacaaggggtaagtaaaaaattagaagaacacttctctaaaaaagcaataaaatgtgaaccgtcatcaggaggggacctagaaattacaacacatagctttaattgtagaggagaatttttctattgcgacacatcacaactgtttaatagtacatacagtcccagttttaatggtacagaaaataaattaaacgggaccatcacaatcacatgtagaataaaacaaattataaacatgtggcaaaaggtaggaagagcaatgtatgcccctcccattgcaggaaacctaacatgtgaatcagatatcacaggattactattgacacgtgatggaggaaaaacaggtccaaatgacacagagatattcagacctggaggaggggatatgagggacaactggagaaatgaattatataaatataaagtagtagaaattaagccattgggagtagcacccactgaggcaaaaaggagagtggtggagagagaaaaaagagcagtgggaataggagctgtgtgccttgggttcttgggagcagctggaagcactatgggcgcggcgtcaataacgctgacggtacaggccagactattgttgtctggtatagtgcagcagcaaaacaatctgctgagggctatagaggcgcaacagcatctgttgcaactcacagtctggggcattaagcagctccagacaagaatcttggctgtagaaagatacctaaaggatcaacagctcctagggatttggggctgctctggaaaactcatctgcaccactgctgtgccttggaactccagttggagtaatagatctcatgatgagatttgggataacatgacctggatgcagtgggatagagaaattaataattacacagacacaatatacaggttgcttgaagaatcacaaaaccagcaggagaaaaatgaaaaggatttattagcattggacagttggcaaaatctgtggaattggtttagcataacaaattggctgtggtatataaaaatattcataatgatagtaggaggcttgataggtttaagaataatttttgctgtgctttctatagtgaatagagttaggcagggatactcacctctgccgtttcagacccttaccccgaacccaagggaacccgacaggctcggaagaatcgaagaagaaggtggagagcaagacagaggcagatccattcgcttagtgagcggattcttagcgcttgcctgggacgacctgcggagcctgtgccttttcagctaccaccgattgagagacttcatattgattgcagcaagagtgttggaacttctgggacagagggggtgggaagcccttaaatatctgggaagccttgtgcagtattggggtctagagctaaaaaagagtgctattagtctgcttgataccatagcaatagcagtagctgaaggaacagataggattatagaattcatacaaagaatttgtagagctattcgcaacatacctagaagaataagacagggctttgaagcagctttgcaataa

SEQ ID NO: 44 - protein, 849 aa, Human immunodeficiency virus type 1
MRVMGILKNYQQWWMWGILGFWMLIISSVVGNLWVTVYYGVPVWKEAKTTLFCTSDAKAYETEVHNVWATHACVPTDPNPQEIVLENVTENFNMWKNDMVDQMHEDIISLWDQSLKPCVKLTPLCVTLKCRNVNATNNINSMIDNSNKGEMKNCSFNVTTELRDRKQEVHALFYRLDVVPLQGNNSNEYRLINCNTSAITQACPKVSFDPIPIHYCTPAGYAILKCNNQTFNGTGPCNNVSSVQCAHGIKPVVSTQLLLNGSVAKGEIIIRSENLTNNAKIIIVQLNKPVKIVCVRPNNNTRKSVRIGPGQTFYATGEIIGDIRQAYCIINKTEWNSTLQGVSKKLEEHFSKKAIKCEPSSGGDLEITTHSFNCRGEFFYCDTSQLFNSTYSPSFNGTENKLNGTITITCRIKQIINMWQKVGRAMYAPPIAGNLTCESDITGLLLTRDGGKTGPNDTEIFRPGGGDMRDNWRNELYKYKVVEIKPLGVAPTEAKRRVVEREKRAVGIGAVCLGFLGAAGSTMGAASITLTVQARLLLSGIVQQQNNLLRAIEAQQHLLQLTVWGIKQLQTRILAVERYLKDQQLLGIWGCSGKLICTTAVPWNSSWSNRSHDEIWDNMTWMQWDREINNYTDTIYRLLEESQNQQEKNEKDLLALDSWQNLWNWFSITNWLWYIKIFIMIVGGLIGLRIIFAVLSIVNRVRQGYSPLPFQTLTPNPREPDRLGRIEEEGGEQDRGRSIRLVSGFLALAWDDLRSLCLFSYHRLRDFILIAARVLELLGQRGWEALKYLGSLVQYWGLELKKSAISLLDTIAIAVAEGTDRIIEFIQRICRAIRNIPRRIRQGFEAALQ

SEQ ID NO: 45 - DNA, 2550 bp, Artificial
  deoptimized HIV-1 ENV sequence
atgcgtgtcatgggtatactcaagaattatcagcaatggtggatgtggggtatcctcggtttttggatgctcataatttcgtcggtcgtcggtaacctctgggtcacggtctattatggtgtcccggtctggaaagaagcgaaaacgacgctcttctgtacgtcggatgcgaaagcgtatgagacggaggtccataatgtctgggcgacgcatgcgtgtgtcccgacggacccgaacccgcaagaaatagtcctcgaaaatgtcacggaaaattttaacatgtggaaaaatgacatggtcgatcagatgcatgaggatataatctcgctctgggaccaatcgctcaagccgtgtgtcaagctcacgccgctctgtgtcacgctcaaatgtcgtaatgtcaatgcgacgaacaatattaattcgatgattgataactcgaataagggtgaaatgaaaaattgctcgttcaatgtcacgacggaactccgtgatcgtaaacaggaagtccatgcgctcttttatcgtctcgatgtcgtcccgctccagggtaacaactcgaatgagtatcgtctcataaattgtaatacgtcggcgataacgcaagcgtgtccgaaggtctcgtttgatccgattccgatacattattgtacgccggcgggttatgcgattctcaagtgtaataatcagacgttcaatggtacgggtccgtgcaataatgtctcgtcggtccaatgtgcgcatggtattaagccggtcgtctcgacgcagctcctcctcaatggttcggtcgcgaaaggtgagataataattcgttcggaaaatctcacgaacaatgcgaaaataataatagtccaactcaataaaccggtcaaaattgtctgtgtccgtccgaacaataatacgcgtaaatcggtccgtataggtccgggtcaaacgttctatgcgacgggtgaaataataggtgacatacgtcaagcgtattgtatcattaataaaacggaatggaattcgacgctccaaggtgtctcgaaaaaactcgaagaacacttctcgaaaaaagcgataaaatgtgaaccgtcgtcgggtggtgacctcgaaattacgacgcattcgtttaattgtcgtggtgaatttttctattgcgacacgtctcaactctttaattcgacgtactcgccgtcgtttaatggtacggaaaataaactcaacggtacgatcacgatcacgtgtcgtataaaacaaattataaacatgtggcaaaaggtcggtcgtgcgatgtatgcgccgccgattgcgggtaacctcacgtgtgaatcggatatcacgggtctcctcctcacgcgtgatggtggtaaaacgggtccgaatgacacggagatattccgtccgggtggtggtgatatgcgtgacaactggcgtaatgaactctataaatataaagtcgtcgaaattaagccgctcggtgtcgcgccgacggaggcgaaacgtcgtgtcgtcgagcgtgaaaaacgtgcggtcggtataggtgcggtctgcctcggtttcctcggtgcggcgggttcgacgatgggtgcggcgtcgataacgctcacggtccaggcgcgtctcctcctctcgggtatagtccagcagcaaaacaatctcctccgtgcgatagaggcgcaacagcatctcctccaactcacggtctggggtattaagcagctccagacgcgtatcctcgcggtcgaacgttacctcaaggatcaacagctcctcggtatttggggttgctcgggtaaactcatctgcacgacggcggtcccgtggaactcgtcgtggtcgaatcgttcgcatgatgagatttgggataacatgacgtggatgcagtgggatcgtgaaattaataattacacggacacgatataccgtctcctcgaagaatcgcaaaaccagcaggagaaaaatgaaaaggatctcctcgcgctcgactcgtggcaaaatctctggaattggttttcgataacgaattggctctggtatataaaaatattcataatgatagtcggtggtctcataggtctccgtataatttttgcggtcctctcgatagtcaatcgtgtccgtcagggttactcgccgctcccgtttcagacgctcacgccgaacccgcgtgaaccggaccgtctcggtcgtatcgaagaagaaggtggtgagcaagaccgtggtagttcgattcgtctcgtctcgggtttcctcgcgctcgcgtgggacgacctccgttcgctctgcctcttctcgtaccaccgtctccgtgacttcatactcattgcggcgcgtgtcctcgaactcctcggtcagcgtggttgggaagcgctcaaatatctcggttcgctcgtccagtattggggtctcgagctcaaaaagtcggcgatttcgctcctcgatacgatagcgatagcggtcgcggaaggtacggatcgtattatagaattcatacaacgtatttgtcgtgcgattcgtaacataccgcgtcgtatacgtcagggttttgaagcggcgctccaataa

SEQ ID NO: 46 - DNA, 1734 bp, Escherichia coli
  CDS (1)..(1734)
gtgaatattcaggctcttctctcagaaaaagtccgtcaggccatgattgcggcaggcgcgcctgcggattgcgaaccgcaggttcgtcagtcagcaaaagttcagttcggcgactatcaggctaacggcatgatggcagttgctaaaaaactgggtatggcaccgcgacaattagcagagcaggtgctgactcatctggatcttaacggtatcgccagcaaagttgagatcgccggtccaggctttatcaacattttccttgatccggcattcctggctgaacatgttcagcaggcgctggcgtccgatcgtctcggtgttgctacgccagaaaaacagaccattgtggttgactactctgcgccaaacgtggcgaaagagatgcatgtcggtcacctgcgctctaccattattggtgacgcagcagtgcgtactctggagttcctcggtcacaaagtgattcgcgcaaaccacgtcggcgactggggcactcagttcggtatgctgattgcatggctggaaaagcagcagcaggaaaacgccggtgaaatggagctggctgaccttgaaggtttctaccgcgatgcgaaaaagcattacgatgaagatgaagagttcgccgagcgcgcacgtaactacgtggtaaaactgcaaagcggtgacgaatatttccgcgagatgtggcgcaaactggtcgacatcaccatgacgcagaaccagatcacctacgatcgtctcaacgtgacgctgacccgtgatgacgtgatgggcgaaagcctctacaacccgatgctgccaggaattgtggcggatctcaaagccaaaggtctggcagtagaaagcgaaggggcgaccgtcgtattccttgatgagtttaaaaacaaggaaggcgaaccgatgggcgtgatcattcagaagaaagatggcggctatctctacaccaccactgatatcgcctgtgcgaaatatcgttatgaaacactgcatgccgatcgcgtgctgtattacatcgactcccgtcagcatcaacacctgatgcaggcatgggcgatcgtccgtaaagcaggctatgtaccggaatccgtaccgctggaacaccacatgttcggcatgatgctgggtaaagacggcaaaccgttcaaaacccgcgcgggtggtacagtgaaactggccgatctgctggatgaagccctggaacgtgcacgccgtctggtggcagaaaagaacccggatatgccagccgacgagctggaaaaactggctaacgcggttggtattggtgcggtgaaatatgcggatctctccaaaaaccgcaccacggactacatcttcgactgggacaacatgctggcgtttgagggtaataccgcgccatacatgcagtatgcatacacgcgtgtattgtccgtgttccgtaaagcagaaattgacgaagagcaactggctgcagctccggttatcatccgtgaagatcgtgaagcgcaactggcagctcgcctgctgcagtttgaagaaaccctcaccgtggttgcccgtgaaggcacgccgcatgtaatgtgtgcttacctgtacgatctggccggtctgttctctggcttctacgagcactgcccgatcctcagcgcagaaaacgaagaagtgcgtaacagccgtctaaaactggcacaactgacggcgaagacgctgaagctgggtctggatacgctgggtattgagactgtagagcgtatgtaa

SEQ ID NO: 47 - protein, 577 aa, Escherichia coli
VNIQALLSEKVRQAMIAAGAPADCEPQVRQSAKVQFGDYQANGMMAVAKKLGMAPRQLAEQVLTHLDLNGIASKVEIAGPGFINIFLDPAFLAEHVQQALASDRLGVATPEKQTIVVDYSAPNVAKEMHVGHLRSTIIGDAAVRTLEFLGHKVIRANHVGDWGTQFGMLIAWLEKQQQENAGEMELADLEGFYRDAKKHYDEDEEFAERARNYVVKLQSGDEYFREMWRKLVDITMTQNQITYDRLNVTLTRDDVMGESLYNPMLPGIVADLKAKGLAVESEGATVVFLDEFKNKEGEPMGVIIQKKDGGYLYTTTDIACAKYRYETLHADRVLYYIDSRQHQHLMQAWAIVRKAGYVPESVPLEHHMFGMMLGKDGKPFKTRAGGTVKLADLLDEALERARRLVAEKNPDMPADELEKLANAVGIGAVKYADLSKNRTTDYIFDWDNMLAFEGNTAPYMQYAYTRVLSVFRKAEIDEEQLAAAPVIIREDREAQLAARLLQFEETLTVVAREGTPHVMCAYLYDLAGLFSGFYEHCPILSAENEEVRNSRLKLAQLTAKTLKLGLDTLGIETVERM

SEQ ID NO: 48 - DNA, 1734 bp, Artificial
  deoptimized E. coli ArgS sequence.
gtgaatattcaggctcttctctcagaaaaagtcaggcaggccatgattgcggcaggcgcgcctgcggattgcgaaccgcaggttaggcagtcagcaaaagttcagttcggcgactatcaggctaacggcatgatggcagttgctaaaaaactgggtatggcaccgaggcaattagcagagcaggtgctgactcatctggatcttaacggtatcgccagcaaagttgagatcgccggtccaggctttatcaacattttccttgatccggcattcctggctgaacatgttcagcaggcgctggcgtccgataggctcggtgttgctacgccagaaaaacagaccattgtggttgactactctgaggcaaacgtggcgaaagagatgcatgtcggtcacctgcgctctaccattattggtgacgcagcagtgaggactctggagttcctcggtcacaaagtgattagggcaaaccacgtcggcgactggggcactcagttcggtatgctgattgcatggctggaaaagcagcagcaggaaaacgccggtgaaatggagctggctgaccttgaaggtttctacagggatgcgaaaaagcattacgatgaagatgaagagttcgccgagagggcaaggaactacgtggtaaaactgcaaagcggtgacgaatatttcagggagatgtggaggaaactggtcgacatcaccatgacgcagaaccagatcacctacgataggctcaacgtgacgctgaccagggatgacgtgatgggcgaaagcctctacaacccgatgctgccaggaattgtggcggatctcaaagccaaaggtctggcagtagaaagcgaaggggcgaccgtcgtattccttgatgagtttaaaaacaaggaaggcgaaccgatgggcgtgatcattcagaagaaagatggcggctatctctacaccaccactgatatcgcctgtgcgaaatataggtatgaaacactgcatgccgatagggtgctgtattacatcgactccaggcagcatcaacacctgatgcaggcatgggcgatcgtcaggaaagcaggctatgtaccggaatccgtaccgctggaacaccacatgttcggcatgatgctgggtaaagacggcaaaccgttcaaaaccagggcgggtggtacagtgaaactggccgatctgctggatgaagccctggaaagggcaaggaggctggtggcagaaaagaacccggatatgccagccgacgagctggaaaaactggctaacgcggttggtattggtgcggtgaaatatgcggatctctccaaaaacaggaccacggactacatcttcgactgggacaacatgctggcgtttgagggtaataccgcgccatacatgcagtatgcatacacgagggtattgtccgtgttcaggaaagcagaaattgacgaagagcaactggctgcagctccggttatcatcagggaagatagggaagcgcaactggcagctaggctgctgcagtttgaagaaaccctcaccgtggttgccagggaaggcacgccgcatgtaatgtgtgcttacctgtacgatctggccggtctgttctctggcttctacgagcactgcccgatcctcagcgcagaaaacgaagaagtgaggaacagcaggctaaaactggcacaactgacggcgaagacgctgaagctgggtctggatacgctgggtattgagactgtagagaggatgtaa

SEQ ID NO: 49 - DNA, 1185 bp, Escherichia coli
  CDS (1)..(1185)
gtgtctaaagaaaaatttgaacgtacaaaaccgcacgttaacgttggtactatcggccacgttgaccacggtaaaactactctgaccgctgcaatcaccaccgtactggctaaaacctacggcggtgctgctcgtgcattcgaccagatcgataacgcgccggaagaaaaagctcgtggtatcaccatcaacacttctcacgttgaatacgacaccccgacccgtcactacgcacacgtagactgcccggggcacgccgactatgttaaaaacatgatcaccggtgctgctcagatggacggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttatattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggcgttgttgctaaagttctgggctaa

SEQ ID NO: 50 - protein, 394 aa, Escherichia coli
VSKEKFERTKPHVNVGTIGHVDHGKTTLTAAITTVLAKTYGGAARAFDQIDNAPEEKARGITINTSHVEYDTPTRHYAHVDCPGHADYVKNMITGAAQMDGAILVVAATDGPMPQTREHILLGRQVGVPYIIVFLNKCDMVDDEELLELVEMEVRELLSQYDFPGDDTPIVRGSALKALEGDAEWEAKILELAGFLDSYIPEPERAIDKPFLLPIEDVFSISGRGTVVTGRVERGIIKVGEEVEIVGIKETQKSTCTGVEMFRKLLDEGRAGENVGVLLRGIKREEIERGQVLAKPGTIKPHTKFESEVYILSKDEGGRHTPFFKGYRPQFYFRTTDVTGTIELPEGVEMVMPGDNIKMVVTLIHPIAMDDGLRFAIREGGRTVGAGVVAKVLG

SEQ ID NO: 51 - DNA, 1185 bp, Artificial
  deoptimized E. coli TufA sequence.
gtgtctaaagaaaaatttgaaaggacaaaaccgcacgttaacgttggtactatcggccacgttgaccacggtaaaactactctgaccgctgcaatcaccaccgtactggctaaaacctacggcggtgctgctagggcattcgaccagatcgataacgcgccggaagaaaaagctaggggtatcaccatcaacacttctcacgttgaatacgacaccccgaccaggcactacgcacacgtagactgcccggggcacgccgactatgttaaaaacatgatcaccggtgctgctcagatggacggcgcgatcctggtagttgctgcgactgacggcccgatgccgcagactagggagcacatcctgctgggtaggcaggtaggcgttccgtacatcatcgtgttcctgaacaaatgcgacatggttgatgacgaagagctgctggaactggttgaaatggaagttagggaacttctgtctcagtacgacttcccgggcgacgacactccgatcgttaggggttctgctctgaaagcgctggaaggcgacgcagagtgggaagcgaaaatcctggaactggctggcttcctggattcttatattccggaaccagagagggcgattgacaagccgttcctgctgccgatcgaagacgtattctccatctccggtaggggtaccgttgttaccggtagggtagaaaggggtatcatcaaagttggtgaagaagttgaaatcgttggtatcaaagagactcagaagtctacctgtactggcgttgaaatgttcacgaaactgctggacgaaggcagggctggtgagaacgtaggtgttctgctgaggggtatcaaaagggaagaaatcgaaaggggtcaggtactggctaagccgggcaccatcaagccgcacaccaagttcgaatctgaagtgtacattctgtccaaagatgaaggcggcaggcatactccgttcttcaaaggctacaggccgcagttctacttcaggactactgacgtgactggtaccatcgaactgccggaaggcgtagagatggtaatgccgggcgacaacatcaaaatggttgttaccctgatccacccgatcgcgatggacgacggtctgaggttcgcaatcagggaaggcggcaggaccgttggcgcgggcgttgttgctaaagttctgggctaa

SEQ ID NO: 52 - DNA, 7439 bp, Human poliovirus 2
ttaaaacagctctggggttgttcccaccccagaggcccacgtggcggccagtacactggtattgcggtacctttgtacgcctgttttatactcccttcccccgtaacttagaagcacaatgtccaagttcaataggagggggtacaaaccagtaccaccacgaacaagcacttctgttcccccggtgaggctgtataggctgtttccacggctaaaagcggctgatccgttatccgctcatgtacttcgagaagcctagtatcaccttggaatcttcgatgcgttgcgctcaacactcaaccccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacctgagagtcctccggcccctgaatgcggctaatcctaaccacggagcaggcagtggcaatccagcgaccagcctgtcgtaacgcgcaagttcgtggcggaaccgactactttgggtgtccgtgtttccttttatttttacaatggctgcttatggtgacaatcattgattgttatcataaagcaaattggattggccatccggtgagaatttgattattaaattactctcttgttgggattgctcctttgaaatcctgtgcactcacacctattggaattacctcattgttaagatatcatcaccactatgggcgcccaagtctcatcacagaaagttggagcccatgagaattcaaacagagcttatggcggatccaccattaattacactactattaattattacagggattctgcgagcaatgccgctagtaagcaggactttgcacaagacccatccaagttcactgaacctattaaagatgttctcattaagaccgctcccacgctaaactctcctaatatcgaggcgtgtgggtatagcgacagagtgatgcaactaaccctaggcaattccaccattaccacacaggaggcggccaattctgtcgttgcatacggccggtggcccgagtacatcaaggactcagaagcaaatcctgtggaccagccaactgaaccggacgttgccgcgtgcaggttttacacactagacactgttacttggcgcaaggagtccagagggtggtggtggaaactgcctgatgcactaaaggacatgggattattcggccagaacatgttctaccactacctcgggagggctggctatactgtgcacgtacagtgtaatgcttcaaagtttcaccagggcgccctcggggtattcgcagttccagaaatgtgcctggcaggcgacagcacaacccacatgtttacaaaatatgagaatgcaaatccgggtgagaaagggggtgaattcaaagggagttttactctggatactaacgctaccaaccctgcacgcaacttttgtcccgttgattatctcttcgggagcggagtactggcgggaaatgcgtttgtttacccacatcagataattaatctgcgcaccaacaactgtgccacgttggtgctgccatacgttaattcactttccatagacagcatgacaaaacacaacaattggggaattgctatccttccgctggcaccacttgactttgccaccgagtcctccactgagatacccattactctaactattgcccctatgtgttgtgaattcaatgggttgcgcaacatcactgtacccagaactcaagggttgccagtcttaaacactccaggaagcaaccagtacttaacagcagacaactatcaatccccatgtgcgatacccgagtttgatgtaacaccacccatagacatcccgggggaagtgcgcaacatgatggaattggcagagatagacaccatgatacctctcaatctgacgaaccagcgcaagaacaccatggatatgtacagagtcgaactgaatgatgcggctcactctgacacaccaatattgtgtctctcactgtctccagcatcagatcctaggctagcacacactatgctaggtgaaatactgaactactacacacactgggcagggtcattgaagttcacatttctcttctgcggctcaatgatggccactggtaaattgctagtgtcctatgcacctcctggtgcggaagcccctaaaagccgcaaagaagcgatgctcggcacccacgtgatctgggacatcggattacagtcatcatgcactatggtggtaccttggattagcaacaccacatacagacaaaccatcaacgatagcttcacagaaggagggtacatcagtatgttttaccaaactagagttgttgtgccattgtccacccctagaaagatggacatattgggctttgtgtcagcctgcaatgacttcagtgtgcgcctgttgcgtgacacgacgcacataagccaagaggctatgccacaaggattgggtgatttaattgaaggggttgttgagggagtcacgagaaatgccttgacaccactgacacctgccaacaacttgcctgatacacaatctagcggcccagcccactctaaggaaacaccagcgctaacagccgtagagacaggggccaccaacccattggtgccttcagacacggtacaaactcgtcacgtcatccaaaagcggacgcggtcggagtctacggttgagtctttcttcgcaagaggagcttgtgtggccattattgaagtggataatgatgctccaacaaagcgtgccagtaaattattttcagtctggaagataacttacaaagacaccgttcagttaagacgtaagttggagttctttacatattcaaggtttgacatggagttcacctttgtggttacatccaattataccgatgcaaacaatgggcacgcactaaatcaagtttaccagataatgtacataccacctggggcaccgatccctggcaagtggaatgattacacatggcaaacgtcatctaacccatcagtgttttacacttacggggcacctccagctagaatatcagtgccctacgtgggcattgccaatgcatattctcatttttacgatgggtttgccaaagtaccactagcaggccaagcctcaacagagggtgactcgctgtatggagcggcttcattgaatgacttcggatcactggctgttcgagtggtgaatgaccacaaccctacgaaactcacttcaaaaatcagagtgtacatgaaaccaaagcacgtcagagtgtggtgtccgcgaccccctcgagcagtcccatactacggaccaggggttgactacaaggatggactagccccactgccagagaaaggcttgacaacctatggttttggccaccaaaataaggcagtgtacacggcaggttacaaaatttgcaattaccacctcgccacccaggaagacttacaaaatgcggtaaacattatgtggattagagaccttttagtagtggaatccaaagcccaaggcatagactcaattgctagatgtaactgccacactggagtgtactactgtgaatccaggaggaagtactacccggtctcttttactggccccacctttcagtacatggaagcaaatgagtactatccagcccgataccaatcccacatgttaattggccatggttttgcatctccaggggactgtggtgggattctcaggtgccaacatggagtaattggaatcattacagctggaggagaaggcctagtcgctttctcggacatcagagatctgtacgcatacgaggaggaggctatggagcagggagtctccaactatattgagtcccttggggctgcatttgggagtggattcacccagcaaataggaaacaaaatttcagaactcactagcatggtcaccagcactataactgagaaactactaaagaatctcattaaaataatttcatcccttgttatcatcaccagaaactatgaagacacgaccacagtgctggctacccttgctctcctcggttgtgatgcgtccccatggcaatggctaaagaagaaagcctgtgacatcttggaaatcccctacatcatgcgacagggcgatagctggttgaagaagtttacagaggcatgcaatgcagccaagggattggaatgggtgtctaataaaatatccaaatttattgactggctcaaagagaagatcattccacaggctagagacaagctagagtttgttaccaaactgaagcaactagaaatgttggagaaccaaattgcaaccattcatcaatcgtgcccaagtcaggagcatcaagaaatcctgttcaataacgtgagatggttatccatacagtcaaagagatttgccccgctctatgcggttgaggctaagagaatacaaaagttagagcacacgattaacaactacgtacagttcaagagcaaacaccgtattgaaccagtatgtttgttggtgcacggtagcccaggcacgggcaagtcagttgccaccaatttaattgccagagcaatagcagagaaggagaacacctccacatactcactaccaccagatccctcccatttcgatgggtacaagcaacaaggtgtggtgatcatggatgatttgaatcagaacccagacggagcagacatgaagctgttttgtcagatggtctccactgtagaattcataccaccaatggcttcgctagaagaaaagggtattttgttcacatctaattacgttttggcctcaaccaattccagtcgcatcaccccaccaactgttgcgcacagcgatgccctagccaggcgctttgcatttgacatggacatacaaatcatgagcgagtattctagagatggaaaattgaacatggcgatggcaactgaaatgtgtaagaactgtcatcaaccagcaaacttcaagagatgttgcccattggtgtgtggcaaagccatccagctgatggacaaatcttccagagtcagatatagtatagatcagattactaccatgattattaatgagaggaacagaagatcaagtatcggtaattgcatggaggcacttttccaaggtcctcttcaatacaaagacctgaaaatagacattaagaccacacctcctcctgagtgcatcaatgatttgctccaagcagttgattctcaagaggtaagagactactgtgagaagaagggttggatagtagacatcactagtcaggtgcaaaccgaaagaaacatcaatagagcaatgactattcttcaggcggtcaccacatttgccgcagttgctggagtggtgtatgtgatgtacaaactctttgcagggcatcaaggagcgtatacagggcttcccaataagagacccaatgtccccaccatcaggactgccaaggttcagggcccaggatttgactacgcagtggcaatggccaaaagaaacattcttacggcaactaccattaagggagagttcacaatgctcggagtgcatgataatgtggccattctaccaacccacgcatcaccgggtgaaacaatagtcattgatggcaaggaagtagaggtactggatgctaaagccctggaggaccaggccgggaccaacctagaaatcaccattgtcactcttaagagaaatgagaagttcagggacatcagaccacacatccccactcaaatcactgagacaaatgatggagttttaattgtgaacactagtaagtaccccaacatgtatgttcctgtcggtgctgtgactgaacaggggtatctcaatctcggtggacgccaaactgctcgtactttaatgtacaactttccaacgagagcaggtcaatgtggtggagttatcacctgcactggcaaggtcatcgggatgcatgttggtgggaacggttcacatgggttcgcagcagccctgaagcgatcctatttcactcagagtcaaggtgaaatccagtggatgagaccatcaaaagaagtgggctaccccgttattaatgctccatctaaaactaaactggaacccagtgcattccattatgtgtttgaaggtgtcaaggaaccagctgtgctcaccaaaagtgaccccagattgaagacagattttgaagaggctatcttttccaagtatgtgggaaataagattactgaagtggatgagtacatgaaagaagctgtcgatcattacgcaggccagctcatgtcactagacatcaacacagaacaaatgtgccttgaggatgcaatgtatggcactgacggtctcgaagctctagacctcagtaccagtgctgggtatccctatgtggcaatggggaaaaagaaaagagacattttgaataagcaaaccagagacacaaaggaaatgcaaaggcttctggacacctatggtattaatttacctttagtcacctatgtgaaagatgagcttagatccaagaccaaagtggaacagggcaagtccaggctaattgaggcctcaagtctcaatgactctgtcgccatgaggatggcttttggcaacttgtacgcagcattccacaagaacccaggtgtagtgacaggatcggctgttggctgtgacccagatttgttttggagtaaaataccagtcctcatggaggaaaaactctttgcatttgattacacgggttatgatgcttcactaagccccgcctggtttgaggctctcaagatggttctagagaaaattgggtttggtgacagagtggattacattgattatctgaatcactcgcaccatctatataaaaataagacatattgtgttaagggcggcatgccatctggctgctctggcacctcaatttttaattcaatgattaataatctaataatcaggactctcttactgaaaacctacaagggcatagatttagaccacctgaagatgatagcctatggtgatgatgtaattgcttcctacccccatgaggttgatgctagtctcctagcccaatcaggaaaagactatggactaaccatgacaccagctgacaaatcagccacctttgaaacagtcacatgggagaatgtaacattcttgaaaagattctttagagcagatgaaaagtatccctttctggtacatccagtgatgccaatgaaagaaattcacgaatcaattagatggactaaagatcccagaaacactcaggatcatgttcgctcactgtgcttattggcttggcacaatggcgaggaagagtacaataaatttttagctaagattagaagtgtgccaatcggaagagcattactgctccctgagtactccacattgtaccgccgttggctcgactcattttagtaaccctacctcagtcgaattggattgggtcatactgttgtaggggtaaatttttctttaattcggag

SEQ ID NO: 53 - DNA, 7439 bp, Human poliovirus 2
ttaaaacagctctggggttgttcccaccccagaggcccacgtggcggccagtacactggtattgcggtacctttgtacgcctgttttatactcccttcccccgtaacttagaagcacaatgtccaagttcaataggagggggtacaaaccagtaccaccacgaacaagcacttctgttcccccggtgaggctgtataggctgtttccacggctaaaagcggctgatccgttatccgctcatgtacttcgagaagcctagtatcaccttggaatcttcgatgcgttgcgctcaacactcaaccccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacctgagagtcctccggcccctgaatgcggctaatcctaaccacggagcaggcagtggcaatccagcgaccagcctgtcgtaacgcgcaagttcgtggcggaaccgactactttgggtgtccgtgtttccttttatttttacaatggctgcttatggtgacaatcattgattgttatcataaagcaaattggattggccatccggtgagaatttgattattaaattactctcttgttgggattgctcctttgaaatcctgtgcactcacacctattggaattacctcattgttaagatatcatcaccactatgggcgcccaagtctcatcacagaaagttggagcccatgagaattcaaacagagcttatggcggatccaccattaattacactactattaattattacagggattctgcgagcaatgccgctagtaagcaggactttgcacaagacccatccaagttcactgaacctattaaagatgttctcattaagaccgctcccacgctaaactctcctaatatcgaggcgtgtgggtatagcgacagagtgatgcaactaaccctaggcaattccaccattaccacacaggaggcggccaattctgtcgttgcatacggccggtggcccgagtacatcaaggactcagaagcaaatcctgtggaccagccaactgaaccggacgttgccgcgtgcaggttttacacactagacactgttacttggcgcaaggagtccagagggtggtggtggaaactgcctgatgcactaaaggacatgggattattcggccagaacatgttctaccactacctcgggagggctggctatactgtgcacgtacagtgtaatgcttcaaagtttcaccagggcgccctcggggtattcgcagttccagaaatgtgcctggcaggcgacagcacaacccacatgtttacaaaatatgagaatgcaaatccgggtgagaaagggggtgaattcaaagggagttttactctggatactaacgctaccaaccctgcacgcaacttttgtcccgttgattatctcttcgggagcggagtactggcgggaaatgcgtttgtttacccacatcagataattaatctgcgcaccaacaactgtgccacgttggtgctgccatacgttaattcactttccatagacagcatgacaaaacacaacaattggggaattgctatccttccgctggcaccacttgactttgccaccgagtcctccactgagatacccattactctaactattgcccctatgtgttgtgaattcaatgggttgcgcaacatcactgtacccagaactcaagggttaccggtcttaaacactccaggaagcaaccagtacttaacagcagacaactatcaatccccatgtgcgatacccgagtttgatgtaacaccacccatagacatcccgggggaagtgcgcaacatgatggaattggcagagatagacaccatgatacctctcaatctgacgaaccagcgcaagaacaccatggatatgtacagagtcgaactgaatgatgcggctcactctgacacaccaatattgtgtctctcactgtctccagcatcagatcctaggctagcacacactatgctaggtgaaatactgaactactacacacactgggcagggtcattgaagttcacatttctcttctgcggctcaatgatggccactggtaaattgctagtgtcctatgcacctcctggtgcggaagcccctaaaagccgcaaagaagcgatgctcggcacccacgtgatctgggacatcggattacagtcatcatgcactatggtggtaccttggattagcaacaccacatacagacaaaccatcaacgatagcttcacagaaggagggtacatcagtatgttttaccaaactagagttgttgtgccattgtccacccctagaaagatggacatattgggctttgtgtcagcctgcaatgacttcagtgtgcgcctgttgcgtgacacgacgcacataagccaagaggctatgccacaaggattgggtgatttaattgaaggggttgttgagggagtcacgagaaatgccttgacaccactgacacctgccaacaacttgcctgatacacaatctagcggcccagcccactctaaggaaacaccagcgctaacagccgtagagacaggggccaccaacccattggtgccttcagacacggtacaaactcgtcacgtcatccaaaagcggacgcggtcggagtctacggttgagtctttcttcgcaagaggagcttgtgtggccattattgaagtggataatgatgctccaacaaagcgtgccagtaaattattttcagtctggaagataacttacaaagacaccgttcagttaagacgtaagttggagttctttacatattcaaggtttgacatggagttcacctttgtggttacatccaattataccgatgcaaacaatgggcacgcactaaatcaagtttaccagataatgtacataccacctggggcaccgatccctggcaagtggaatgattacacatggcaaacgtcatctaacccatcagtgttttacacttacggggcacctccagctagaatatcagtgccctacgtgggcattgccaatgcatattctcatttttacgatgggtttgccaaagtaccactagcaggccaagcctcaacagagggtgactcgctgtatggagcggcttcattgaatgacttcggatcactggctgttcgagtggtgaatgaccacaaccctacgaaactcacttcaaaaatcagagtgtacatgaaaccaaagcacgtcagagtgtggtgtccgcgaccccctcgagcagtcccatactacggaccaggggttgactacaaggatggactagccccactgccagagaaaggcttgacaacctatggttttggccaccaaaataaggcagtgtacacggcaggttacaaaatttgcaattaccacctcgccacccaggaagacttacaaaatgcggtaaacattatgtggattagagaccttttagtagtggaatccaaagcccaaggcatagactcaattgctagatgtaactgccacactggagtgtactactgtgaatccaggaggaagtactacccggtctcttttactggccccacctttcagtacatggaagcaaatgagtactatccagcccgataccaatcccacatgttaattggccatggttttgcatctccaggggactgtggtgggattctcaggtgccaacatggagtaattggaatcattacagctggaggagaaggcctagtcgctttctcggacatcagagatctgtacgcatacgaggaggaggctatggagcagggagtctccaactatattgagtcccttggggctgcatttgggagtggattcacccagcaaataggaaacaaaatttcagaactcactagcatggtcaccagcactataactgagaaactactaaagaatctcattaaaataatttcatcccttgttatcatcaccagaaactatgaagacacgaccacagtgctggctacccttgctctcctcggttgtgatgcgtccccatggcaatggctaaagaagaaagcctgtgacatcttggaaatcccctacatcatgcgacagggcgatagctggttgaagaagtttacagaggcatgcaatgcagccaagggattggaatgggtgtctaataaaatatccaaatttattgactggctcaaagagaagatcattccacaggctagagacaagctagagtttgttaccaaactgaagcaactagaaatgttggagaaccaaattgcaaccattcatcaatcgtgcccaagtcaggagcatcaagaaatcctgttcaataacgtgagatggttatccatacagtcaaagagatttgccccgctctatgcggttgaggctaagagaatacaaaagttagagcacacgattaacaactacgtacagttcaagagcaaacaccgtattgaaccagtatgtttgttggtgcacggtagcccaggcacgggcaagtcagttgccaccaatttaattgccagagcaatagcagagaaggagaacacctccacatactcactaccaccagatccctcccatttcgatgggtacaagcaacaaggtgtggtgatcatggatgatttgaatcagaacccagacggagcagacatgaagctgttttgtcagatggtctccactgtagaattcataccaccaatggcttcgctagaagaaaagggtattttgttcacatctaattacgttttggcctcaaccaattccagtcgcatcaccccaccaactgttgcgcacagcgatgccctagccaggcgctttgcatttgacatggacatacaaatcatgagcgagtattctagagatggaaaattgaacatggcgatggcaactgaaatgtgtaagaactgtcatcaaccagcaaacttcaagagatgttgcccattggtgtgtggcaaagccatccagctgatggacaaatcttccagagtcagatatagtatagatcagattactaccatgattattaatgagaggaacagaagatcaagtatcggtaattgcatggaggcacttttccaaggtcctcttcaatacaaagacctgaaaatagacattaagaccacacctcctcctgagtgcatcaatgatttgctccaagcagttgattctcaagaggtaagagactactgtgagaagaagggttggatagtagacatcactagtcaggtgcaaaccgaaagaaacatcaatagagcaatgactattcttcaggcggtcaccacatttgccgcagttgctggagtggtgtatgtgatgtacaaactctttgcagggcatcaaggagcgtatacagggcttcccaataagagacccaatgtccccaccatcaggactgccaaggttcagggcccaggatttgactacgcagtggcaatggccaaaagaaacattcttacggcaactaccattaagggagagttcacaatgctcggagtgcatgataatgtggccattctaccaacccacgcatcaccgggtgaaacaatagtcattgatggcaaggaagtagaggtactggatgctaaagccctggaggaccaggccgggaccaacctagaaatcaccattgtcactcttaagagaaatgagaagttcagggacatcagaccacacatccccactcaaatcactgagacaaatgatggagttttaattgtgaacactagtaagtaccccaacatgtatgttcctgtcggtgctgtgactgaacaggggtatctcaatctcggtggacgccaaactgctcgtactttaatgtacaactttccaacgagagcaggtcaatgtggtggagttatcacctgcactggcaaggtcatcgggatgcatgttggtgggaacggttcacatgggttcgcagcagccctgaagcgatcctatttcactcagagtcaaggtgaaatccagtggatgagaccatcaaaagaagtgggctaccccgttattaatgctccatctaaaactaaactggaacccagtgcattccattatgtgtttgaaggtgtcaaggaaccagctgtgctcaccaaaagtgaccccagattgaagacagattttgaagaggctatcttttccaagtatgtgggaaataagattactgaagtggatgagtacatgaaagaagctgtcgatcattacgcaggccagctcatgtcactagacatcaacacagaacaaatgtgccttgaggatgcaatgtatggcactgacggtctcgaagctctagacctcagtaccagtgctgggtatccctatgtggcaatggggaaaaagaaaagagacattttgaataagcaaaccagagacacaaaggaaatgcaaaggcttctggacacctatggtattaatttacctttagtcacctatgtgaaagatgagcttagatccaagaccaaagtggaacagggcaagtccaggctaattgaggcctcaagtctcaatgactctgtcgccatgaggatggcttttggcaacttgtacgcagcattccacaagaacccaggtgtagtgacaggatcggctgttggctgtgacccagatttgttttggagtaaaataccagtcctcatggaggaaaaactctttgcatttgattacacgggttatgatgcttcactaagccccgcctggtttgaggctctcaagatggttctagagaaaattgggtttggtgacagagtggattacattgattatctgaatcactcgcaccatctatataaaaataagacatattgtgttaagggcggcatgccatctggctgctctggcacctcaatttttaattcaatgattaataatctaataatcaggactctcttactgaaaacctacaagggcatagatttagaccacctgaagatgatagcctatggtgatgatgtaattgcttcctacccccatgaggttgatgctagtctcctagcccaatcaggaaaagactatggactaaccatgacaccagctgacaaatcagccacctttgaaacagtcacatgggagaatgtaacattcttgaaaagattctttagagcagatgaaaagtatccctttctggtacatccagtgatgccaatgaaagaaattcacgaatcaattagatggactaaagatcccagaaacactcaggatcatgttcgctcactgtgcttattggcttggcacaatggcgaggaagagtacaataaatttttagctaagattagaagtgtgccaatcggaagagcattactgctccctgagtactccacattgtaccgccgttggctcgactcattttagtaaccctacctcagtcgaattggattgggtcatactgttgtaggggtaaatttttctttaattcggag

SEQ ID NO: 54 - DNA, 7439 bp, Artificial
  deoptimized MEF1 poliovirus
ttaaaacagctctggggttgttcccaccccagaggcccacgtggcggccagtacactggtattgcggtacctttgtacgcctgttttatactcccttcccccgtaacttagaagcacaatgtccaagttcaataggagggggtacaaaccagtaccaccacgaacaagcacttctgttcccccggtgaggctgtataggctgtttccacggctaaaagcggctgatccgttatccgctcatgtacttcgagaagcctagtatcaccttggaatcttcgatgcgttgcgctcaacactcaaccccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacctgagagtcctccggcccctgaatgcggctaatcctaaccacggagcaggcagtggcaatccagcgaccagcctgtcgtaacgcgcaagttcgtggcggaaccgactactttgggtgtccgtgtttccttttatttttacaatggctgcttatggtgacaatcattgattgttatcataaagcaaattggattggccatccggtgagaatttgattattaaattactctcttgttgggattgctcctttgaaatcctgtgcactcacacctattggaattacctcattgttaagatatcatcaccactatgggcgcccaagtctcatcacagaaagttggagcccatgagaattcaaacagagcttatggcggatccaccattaattacactactattaattattacagggattctgcgagcaatgccgctagtaagcaggactttgcacaagacccatccaagttcactgaacctattaaagatgttctcattaagaccgctcccacgctaaactctcctaatatcgaggcgtgtgggtatagcgacagagtgatgcaactaaccctaggcaattccaccattaccacacaggaggcggccaattctgtcgttgcatacggccggtggcccgagtacatcaaggactcagaagcaaatcctgtggaccagccaactgaaccggacgttgccgcgtgcaggttttacacactagacactgttacttggcgcaaggagtccagagggtggtggtggaaactgcctgatgcactaaaggacatgggattattcggccagaacatgttctaccactacctcgggagggctggctatactgtgcacgtacagtgtaatgcttcaaagtttcaccagggcgccctcggggtattcgcagttccagaaatgtgcctggcaggcgacagcacaacccacatgtttacaaaatatgagaatgcaaatccgggtgagaaagggggtgaattcaaagggagttttactctggatactaacgctaccaaccctgcacgcaacttttgtcccgttgattatctcttcgggagcggagtactggcgggaaatgcgtttgtttacccacatcagataattaatctgcgcaccaacaactgtgccacgttggtgctgccatacgttaattcactttccatagacagcatgacaaaacacaacaattggggaattgctatccttccgctggcaccacttgactttgccaccgagtcctccactgagatacccattactctaactattgcccctatgtgttgtgaattcaatgggttgcgcaacatcactgtacccagaactcaagggttaccggtcttaaacactccaggaagcaaccagtacttaacagcagacaactatcaatccccatgtgcgatacccgagtttgatgtaacaccacccatagacatcccgggggaagtgcgcaacatgatggaattggcagagatagacaccatgatacctctcaatctgacgaaccagcgcaagaacaccatggatatgtacagagtcgaactgaatgatgcggctcactctgacacaccaatattgtgtctctcactgtctccagcatcagatcctaggctagcacacactatgctaggtgaaatactgaactactacacacactgggcagggtcattgaagttcacatttctcttctgcggctcaatgatggccactggtaaattgctagtgtcctatgcacctcctggtgcggaagcccctaaaagccgcaaagaagcgatgctcggcacccacgtgatctgggacatcggattacagtcatcatgcactatggtggtaccttggattagcaacaccacatacagacaaaccatcaacgatagcttcacagaaggagggtacatcagtatgttttaccaaactagagttgttgtgccattgtccacccctagaaagatggacatattgggctttgtgtcagcctgcaatgacttcagtgtgcgcctgttgcgtgacacgacgcacataagccaagaggctatgccacaaggattgggtgatttaattgaaggggttgttgagggagtcacgagaaatgccttgacaccactgacacctgccaacaacttgcctgatacacaatctagcggcccagcccactctaaggaaacaccagcgcttacggcggtcgagacgggtgcgacgaacccgcttgtcccgagcgacacggtccaaacgcggcacgtcatccaaaagcggacgcggagcgagagcacggtcgagagcttcttcgcgcggggtgcgtgtgtcgcgatcatcgaagtcgataatgatgcgccgacgaagcgggcgagcaaactttttagcgtctggaagatcacgtacaaagacacggtccagcttcggcggaagctggagttctttacgtatagccggtttgacatggagttcacgtttgtcgtcacgagcaattatacggatgcgaacaatggtcacgcgcttaatcaagtctaccagatcatgtacatcccgccgggtgcgccgatcccgggtaagtggaatgattacacgtggcaaacgagcagcaacccgagcgtcttttacacgtacggtgcgccgccggcgcggatcagcgtcccgtacgtcggtatcgcgaatgcgtatagccatttttacgatggttttgcgaaagtcccgcttgcgggtcaagcgagcacggagggtgacagcctttatggtgcggcgagccttaatgacttcggtagccttgcggtccgggtcgtcaatgaccacaacccgacgaaacttacgagcaaaatccgggtctacatgaaaccgaagcacgtccgggtctggtgtccgcggccccctcgagcagtcccatactacggaccaggggttgactacaaggatggactagccccactgccagagaaaggcttgacaacctatggttttggccaccaaaataaggcagtgtacacggcaggttacaaaatttgcaattaccacctcgccacccaggaagacttacaaaatgcggtaaacattatgtggattagagaccttttagtagtggaatccaaagcccaaggcatagactcaattgctagatgtaactgccacactggagtgtactactgtgaatccaggaggaagtactacccggtctcttttactggccccacctttcagtacatggaagcaaatgagtactatccagcccgataccaatcccacatgttaattggccatggttttgcatctccaggggactgtggtgggattctcaggtgccaacatggagtaattggaatcattacagctggaggagaaggcctagtcgctttctcggacatcagagatctgtacgcatacgaggaggaggctatggagcagggagtctccaactatattgagtcccttggggctgcatttgggagtggattcacccagcaaataggaaacaaaatttcagaactcactagcatggtcaccagcactataactgagaaactactaaagaatctcattaaaataatttcatcccttgttatcatcaccagaaactatgaagacacgaccacagtgctggctacccttgctctcctcggttgtgatgcgtccccatggcaatggctaaagaagaaagcctgtgacatcttggaaatcccctacatcatgcgacagggcgatagctggttgaagaagtttacagaggcatgcaatgcagccaagggattggaatgggtgtctaataaaatatccaaatttattgactggctcaaagagaagatcattccacaggctagagacaagctagagtttgttaccaaactgaagcaactagaaatgttggagaaccaaattgcaaccattcatcaatcgtgcccaagtcaggagcatcaagaaatcctgttcaataacgtgagatggttatccatacagtcaaagagatttgccccgctctatgcggttgaggctaagagaatacaaaagttagagcacacgattaacaactacgtacagttcaagagcaaacaccgtattgaaccagtatgtttgttggtgcacggtagcccaggcacgggcaagtcagttgccaccaatttaattgccagagcaatagcagagaaggagaacacctccacatactcactaccaccagatccctcccatttcgatgggtacaagcaacaaggtgtggtgatcatggatgatttgaatcagaacccagacggagcagacatgaagctgttttgtcagatggtctccactgtagaattcataccaccaatggcttcgctagaagaaaagggtattttgttcacatctaattacgttttggcctcaaccaattccagtcgcatcaccccaccaactgttgcgcacagcgatgccctagccaggcgctttgcatttgacatggacatacaaatcatgagcgagtattctagagatggaaaattgaacatggcgatggcaactgaaatgtgtaagaactgtcatcaaccagcaaacttcaagagatgttgcccattggtgtgtggcaaagccatccagctgatggacaaatcttccagagtcagatatagtatagatcagattactaccatgattattaatgagaggaacagaagatcaagtatcggtaattgcatggaggcacttttccaaggtcctcttcaatacaaagacctgaaaatagacattaagaccacacctcctcctgagtgcatcaatgatttgctccaagcagttgattctcaagaggtaagagactactgtgagaagaagggttggatagtagacatcactagtcaggtgcaaaccgaaagaaacatcaatagagcaatgactattcttcaggcggtcaccacatttgccgcagttgctggagtggtgtatgtgatgtacaaactctttgcagggcatcaaggagcgtatacagggcttcccaataagagacccaatgtccccaccatcaggactgccaaggttcagggcccaggatttgactacgcagtggcaatggccaaaagaaacattcttacggcaactaccattaagggagagttcacaatgctcggagtgcatgataatgtggccattctaccaacccacgcatcaccgggtgaaacaatagtcattgatggcaaggaagtagaggtactggatgctaaagccctggaggaccaggccgggaccaacctagaaatcaccattgtcactcttaagagaaatgagaagttcagggacatcagaccacacatccccactcaaatcactgagacaaatgatggagttttaattgtgaacactagtaagtaccccaacatgtatgttcctgtcggtgctgtgactgaacaggggtatctcaatctcggtggacgccaaactgctcgtactttaatgtacaactttccaacgagagcaggtcaatgtggtggagttatcacctgcactggcaaggtcatcgggatgcatgttggtgggaacggttcacatgggttcgcagcagccctgaagcgatcctatttcactcagagtcaaggtgaaatccagtggatgagaccatcaaaagaagtgggctaccccgttattaatgctccatctaaaactaaactggaacccagtgcattccattatgtgtttgaaggtgtcaaggaaccagctgtgctcaccaaaagtgaccccagattgaagacagattttgaagaggctatcttttccaagtatgtgggaaataagattactgaagtggatgagtacatgaaagaagctgtcgatcattacgcaggccagctcatgtcactagacatcaacacagaacaaatgtgccttgaggatgcaatgtatggcactgacggtctcgaagctctagacctcagtaccagtgctgggtatccctatgtggcaatggggaaaaagaaaagagacattttgaataagcaaaccagagacacaaaggaaatgcaaaggcttctggacacctatggtattaatttacctttagtcacctatgtgaaagatgagcttagatccaagaccaaagtggaacagggcaagtccaggctaattgaggcctcaagtctcaatgactctgtcgccatgaggatggcttttggcaacttgtacgcagcattccacaagaacccaggtgtagtgacaggatcggctgttggctgtgacccagatttgttttggagtaaaataccagtcctcatggaggaaaaactctttgcatttgattacacgggttatgatgcttcactaagccccgcctggtttgaggctctcaagatggttctagagaaaattgggtttggtgacagagtggattacattgattatctgaatcactcgcaccatctatataaaaataagacatattgtgttaagggcggcatgccatctggctgctctggcacctcaatttttaattcaatgattaataatctaataatcaggactctcttactgaaaacctacaagggcatagatttagaccacctgaagatgatagcctatggtgatgatgtaattgcttcctacccccatgaggttgatgctagtctcctagcccaatcaggaaaagactatggactaaccatgacaccagctgacaaatcagccacctttgaaacagtcacatgggagaatgtaacattcttgaaaagattctttagagcagatgaaaagtatccctttctggtacatccagtgatgccaatgaaagaaattcacgaatcaattagatggactaaagatcccagaaacactcaggatcatgttcgctcactgtgcttattggcttggcacaatggcgaggaagagtacaataaatttttagctaagattagaagtgtgccaatcggaagagcattactgctccctgagtactccacattgtaccgccgttggctcgactcattttagtaaccctacctcagtcgaattggattgggtcatactgttgtaggggtaaatttttctttaattcggag

SEQ ID NO: 55 - DNA, 7439 bp, Artificial
  deoptimized MEF1 poliovirus
ttaaaacagctctggggttgttcccaccccagaggcccacgtggcggccagtacactggtattgcggtacctttgtacgcctgttttatactcccttcccccgtaacttagaagcacaatgtccaagttcaataggagggggtacaaaccagtaccaccacgaacaagcacttctgttcccccggtgaggctgtataggctgtttccacggctaaaagcggctgatccgttatccgctcatgtacttcgagaagcctagtatcaccttggaatcttcgatgcgttgcgctcaacactcaaccccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacctgagagtcctccggcccctgaatgcggctaatcctaaccacggagcaggcagtggcaatccagcgaccagcctgtcgtaacgcgcaagttcgtggcggaaccgactactttgggtgtccgtgtttccttttatttttacaatggctgcttatggtgacaatcattgattgttatcataaagcaaattggattggccatccggtgagaatttgattattaaattactctcttgttgggattgctcctttgaaatcctgtgcactcacacctattggaattacctcattgttaagatatcatcaccactatgggtgcgcaagtcagcagccagaaagtcggtgcgcatgagaatagcaaccgggcgtatggtggtagcacgatcaattacacgacgatcaattattaccgggatagcgcgagcaatgcggcgagcaagcaggactttgcgcaagacccgagcaagttcacggaaccgatcaaagatgtccttatcaagacggcgccgacgcttaacagcccgaatatcgaggcgtgtggttatagcgaccgggtcatgcaacttacgcttggtaatagcacgatcacgacgcaggaggcggcgaatagcgtcgtcgcgtacggccggtggccggagtacatcaaggacagcgaagcgaatccggtggaccagccgacggaaccggacgtcgcggcgtgccggttttacacgcttgacacggtcacgtggcggaaggagagccggggttggtggtggaaacttccggatgcgcttaaggacatgggtcttttcggtcagaacatgttctaccactaccttggtcgggcgggttatacggtccacgtccagtgtaatgcgagcaagtttcaccagggtgcgcttggtgtcttcgcggtcccggaaatgtgccttgcgggtgacagcacgacgcacatgtttacgaaatatgagaatgcgaatccgggtgagaaaggtggtgaattcaaaggtagctttacgcttgatacgaacgcgacgaacccggcgcggaacttttgtccggtcgattatcttttcggtagcggtgtccttgcgggtaatgcgtttgtctacccgcatcagatcatcaatcttcggacgaacaactgtgcgacgcttgtccttccgtacgtcaatagccttagcatcgacagcatgacgaaacacaacaattggggtatcgcgatccttccgcttgcgccgcttgactttgcgacggagagcagcacggagatcccgatcacgcttacgatcgcgccgatgtgttgtgaattcaatggtcttcggaacatcacggtcccgcggacgcaaggtctaccggtcttaaacactccaggaagcaaccagtacttaacagcagacaactatcaatccccatgtgcgatacccgagtttgatgtaacaccacccatagacatcccgggggaagtgcgcaacatgatggaattggcagagatagacaccatgatacctctcaatctgacgaaccagcgcaagaacaccatggatatgtacagagtcgaactgaatgatgcggctcactctgacacaccaatattgtgtctctcactgtctccagcatcagatcctaggctagcacacactatgctaggtgaaatactgaactactacacacactgggcagggtcattgaagttcacatttctcttctgcggctcaatgatggccactggtaaattgctagtgtcctatgcacctcctggtgcggaagcccctaaaagccgcaaagaagcgatgctcggcacccacgtgatctgggacatcggattacagtcatcatgcactatggtggtaccttggattagcaacaccacatacagacaaaccatcaacgatagcttcacagaaggagggtacatcagtatgttttaccaaactagagttgttgtgccattgtccacccctagaaagatggacatattgggctttgtgtcagcctgcaatgacttcagtgtgcgcctgttgcgtgacacgacgcacataagccaagaggctatgccacaaggattgggtgatttaattgaaggggttgttgagggagtcacgagaaatgccttgacaccactgacacctgccaacaacttgcctgatacacaatctagcggcccagcccactctaaggaaacaccagcgctaacagccgtagagacaggggccaccaacccattggtgccttcagacacggtacaaactcgtcacgtcatccaaaagcggacgcggtcggagtctacggttgagtctttcttcgcaagaggagcttgtgtggccattattgaagtggataatgatgctccaacaaagcgtgccagtaaattattttcagtctggaagataacttacaaagacaccgttcagttaagacgtaagttggagttctttacatattcaaggtttgacatggagttcacctttgtggttacatccaattataccgatgcaaacaatgggcacgcactaaatcaagtttaccagataatgtacataccacctggggcaccgatccctggcaagtggaatgattacacatggcaaacgtcatctaacccatcagtgttttacacttacggggcacctccagctagaatatcagtgccctacgtgggcattgccaatgcatattctcatttttacgatgggtttgccaaagtaccactagcaggccaagcctcaacagagggtgactcgctgtatggagcggcttcattgaatgacttcggatcactggctgttcgagtggtgaatgaccacaaccctacgaaactcacttcaaaaatcagagtgtacatgaaaccaaagcacgtcagagtgtggtgtccgcgaccccctcgagcagtcccatactacggaccaggggttgactacaaggatggactagccccactgccagagaaaggcttgacaacctatggttttggccaccaaaataaggcagtgtacacggcaggttacaaaatttgcaattaccacctcgccacccaggaagacttacaaaatgcggtaaacattatgtggattagagaccttttagtagtggaatccaaagcccaaggcatagactcaattgctagatgtaactgccacactggagtgtactactgtgaatccaggaggaagtactacccggtctcttttactggccccacctttcagtacatggaagcaaatgagtactatccagcccgataccaatcccacatgttaattggccatggttttgcatctccaggggactgtggtgggattctcaggtgccaacatggagtaattggaatcattacagctggaggagaaggcctagtcgctttctcggacatcagagatctgtacgcatacgaggaggaggctatggagcagggagtctccaactatattgagtcccttggggctgcatttgggagtggattcacccagcaaataggaaacaaaatttcagaactcactagcatggtcaccagcactataactgagaaactactaaagaatctcattaaaataatttcatcccttgttatcatcaccagaaactatgaagacacgaccacagtgctggctacccttgctctcctcggttgtgatgcgtccccatggcaatggctaaagaagaaagcctgtgacatcttggaaatcccctacatcatgcgacagggcgatagctggttgaagaagtttacagaggcatgcaatgcagccaagggattggaatgggtgtctaataaaatatccaaatttattgactggctcaaagagaagatcattccacaggctagagacaagctagagtttgttaccaaactgaagcaactagaaatgttggagaaccaaattgcaaccattcatcaatcgtgcccaagtcaggagcatcaagaaatcctgttcaataacgtgagatggttatccatacagtcaaagagatttgccccgctctatgcggttgaggctaagagaatacaaaagttagagcacacgattaacaactacgtacagttcaagagcaaacaccgtattgaaccagtatgtttgttggtgcacggtagcccaggcacgggcaagtcagttgccaccaatttaattgccagagcaatagcagagaaggagaacacctccacatactcactaccaccagatccctcccatttcgatgggtacaagcaacaaggtgtggtgatcatggatgatttgaatcagaacccagacggagcagacatgaagctgttttgtcagatggtctccactgtagaattcataccaccaatggcttcgctagaagaaaagggtattttgttcacatctaattacgttttggcctcaaccaattccagtcgcatcaccccaccaactgttgcgcacagcgatgccctagccaggcgctttgcatttgacatggacatacaaatcatgagcgagtattctagagatggaaaattgaacatggcgatggcaactgaaatgtgtaagaactgtcatcaaccagcaaacttcaagagatgttgcccattggtgtgtggcaaagccatccagctgatggacaaatcttccagagtcagatatagtatagatcagattactaccatgattattaatgagaggaacagaagatcaagtatcggtaattgcatggaggcacttttccaaggtcctcttcaatacaaagacctgaaaatagacattaagaccacacctcctcctgagtgcatcaatgatttgctccaagcagttgattctcaagaggtaagagactactgtgagaagaagggttggatagtagacatcactagtcaggtgcaaaccgaaagaaacatcaatagagcaatgactattcttcaggcggtcaccacatttgccgcagttgctggagtggtgtatgtgatgtacaaactctttgcagggcatcaaggagcgtatacagggcttcccaataagagacccaatgtccccaccatcaggactgccaaggttcagggcccaggatttgactacgcagtggcaatggccaaaagaaacattcttacggcaactaccattaagggagagttcacaatgctcggagtgcatgataatgtggccattctaccaacccacgcatcaccgggtgaaacaatagtcattgatggcaaggaagtagaggtactggatgctaaagccctggaggaccaggccgggaccaacctagaaatcaccattgtcactcttaagagaaatgagaagttcagggacatcagaccacacatccccactcaaatcactgagacaaatgatggagttttaattgtgaacactagtaagtaccccaacatgtatgttcctgtcggtgctgtgactgaacaggggtatctcaatctcggtggacgccaaactgctcgtactttaatgtacaactttccaacgagagcaggtcaatgtggtggagttatcacctgcactggcaaggtcatcgggatgcatgttggtgggaacggttcacatgggttcgcagcagccctgaagcgatcctatttcactcagagtcaaggtgaaatccagtggatgagaccatcaaaagaagtgggctaccccgttattaatgctccatctaaaactaaactggaacccagtgcattccattatgtgtttgaaggtgtcaaggaaccagctgtgctcaccaaaagtgaccccagattgaagacagattttgaagaggctatcttttccaagtatgtgggaaataagattactgaagtggatgagtacatgaaagaagctgtcgatcattacgcaggccagctcatgtcactagacatcaacacagaacaaatgtgccttgaggatgcaatgtatggcactgacggtctcgaagctctagacctcagtaccagtgctgggtatccctatgtggcaatggggaaaaagaaaagagacattttgaataagcaaaccagagacacaaaggaaatgcaaaggcttctggacacctatggtattaatttacctttagtcacctatgtgaaagatgagcttagatccaagaccaaagtggaacagggcaagtccaggctaattgaggcctcaagtctcaatgactctgtcgccatgaggatggcttttggcaacttgtacgcagcattccacaagaacccaggtgtagtgacaggatcggctgttggctgtgacccagatttgttttggagtaaaataccagtcctcatggaggaaaaactctttgcatttgattacacgggttatgatgcttcactaagccccgcctggtttgaggctctcaagatggttctagagaaaattgggtttggtgacagagtggattacattgattatctgaatcactcgcaccatctatataaaaataagacatattgtgttaagggcggcatgccatctggctgctctggcacctcaatttttaattcaatgattaataatctaataatcaggactctcttactgaaaacctacaagggcatagatttagaccacctgaagatgatagcctatggtgatgatgtaattgcttcctacccccatgaggttgatgctagtctcctagcccaatcaggaaaagactatggactaaccatgacaccagctgacaaatcagccacctttgaaacagtcacatgggagaatgtaacattcttgaaaagattctttagagcagatgaaaagtatccctttctggtacatccagtgatgccaatgaaagaaattcacgaatcaattagatggactaaagatcccagaaacactcaggatcatgttcgctcactgtgcttattggcttggcacaatggcgaggaagagtacaataaatttttagctaagattagaagtgtgccaatcggaagagcattactgctccctgagtactccacattgtaccgccgttggctcgactcattttagtaaccctacctcagtcgaattggattgggtcatactgttgtaggggtaaatttttctttaattcggag

SEQ ID NO: 56 - DNA, 7439 bp, Artificial
  deoptimized MEF1 poliovirus
ttaaaacagctctggggttgttcccaccccagaggcccacgtggcggccagtacactggtattgcggtacctttgtacgcctgttttatactcccttcccccgtaacttagaagcacaatgtccaagttcaataggagggggtacaaaccagtaccaccacgaacaagcacttctgttcccccggtgaggctgtataggctgtttccacggctaaaagcggctgatccgttatccgctcatgtacttcgagaagcctagtatcaccttggaatcttcgatgcgttgcgctcaacactcaaccccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacctgagagtcctccggcccctgaatgcggctaatcctaaccacggagcaggcagtggcaatccagcgaccagcctgtcgtaacgcgcaagttcgtggcggaaccgactactttgggtgtccgtgtttccttttatttttacaatggctgcttatggtgacaatcattgattgttatcataaagcaaattggattggccatccggtgagaatttgattattaaattactctcttgttgggattgctcctttgaaatcctgtgcactcacacctattggaattacctcattgttaagatatcatcaccactatgggcgcccaagtctcatcacagaaagttggagcccatgagaattcaaacagagcttatggcggatccaccattaattacactactattaattattacagggattctgcgagcaatgccgctagtaagcaggactttgcacaagacccatccaagttcactgaacctattaaagatgttctcattaagaccgctcccacgctaaactctcctaatatcgaggcgtgtgggtatagcgacagagtgatgcaactaaccctaggcaattccaccattaccacacaggaggcggccaattctgtcgttgcatacggccggtggcccgagtacatcaaggactcagaagcaaatcctgtggaccagccaactgaaccggacgttgccgcgtgcaggttttacacactagacactgttacttggcgcaaggagtccagagggtggtggtggaaactgcctgatgcactaaaggacatgggattattcggccagaacatgttctaccactacctcgggagggctggctatactgtgcacgtacagtgtaatgcttcaaagtttcaccagggcgccctcggggtattcgcagttccagaaatgtgcctggcaggcgacagcacaacccacatgtttacaaaatatgagaatgcaaatccgggtgagaaagggggtgaattcaaagggagttttactctggatactaacgctaccaaccctgcacgcaacttttgtcccgttgattatctcttcgggagcggagtactggcgggaaatgcgtttgtttacccacatcagataattaatctgcgcaccaacaactgtgccacgttggtgctgccatacgttaattcactttccatagacagcatgacaaaacacaacaattggggaattgctatccttccgctggcaccacttgactttgccaccgagtcctccactgagatacccattactctaactattgcccctatgtgttgtgaattcaatgggttgcgcaacatcactgtacccagaactcaagggttaccggtccttaacacgccgggtagcaaccagtaccttacggcggacaactatcaaagcccgtgtgcgatcccggagtttgatgtcacgccgccgatcgacatcccgggtgaagtccggaacatgatggaacttgcggagatcgacacgatgatcccgcttaatcttacgaaccagcggaagaacacgatggatatgtaccgggtcgaacttaatgatgcggcgcacagcgacacgccgatcctttgtcttagccttagcccggcgagcgatccgcggctagcgcacacgatgcttggtgaaatccttaactactacacgcactgggcgggtagccttaagttcacgtttcttttctgcggtagcatgatggcgacgggtaaacttcttgtcagctatgcgccgccgggtgcggaagcgccgaaaagccggaaagaagcgatgcttggtacgcacgtcatctgggacatcggtcttcagagcagctgcacgatggtcgtcccgtggatcagcaacacgacgtaccggcaaacgatcaacgatagcttcacggaaggtggttacatcagcatgttttaccaaacgcgggtcgtcgtcccgcttagcacgccgcggaagatggacatccttggttttgtcagcgcgtgcaatgacttcagcgtccggcttcttcgggacacgacgcacatcagccaagaggcgatgccgcaaggtcttggtgatcttatcgaaggtgtcgtcgagggtgtcacgcggaatgcgcttacgccgcttacgccggcgaacaaccttccggatacgcaaagcagcggtccggcgcacagcaaggaaacgccagcgctaacagccgtagagacaggggccaccaacccattggtgccttcagacacggtacaaactcgtcacgtcatccaaaagcggacgcggtcggagtctacggttgagtctttcttcgcaagaggagcttgtgtggccattattgaagtggataatgatgctccaacaaagcgtgccagtaaattattttcagtctggaagataacttacaaagacaccgttcagttaagacgtaagttggagttctttacatattcaaggtttgacatggagttcacctttgtggttacatccaattataccgatgcaaacaatgggcacgcactaaatcaagtttaccagataatgtacataccacctggggcaccgatccctggcaagtggaatgattacacatggcaaacgtcatctaacccatcagtgttttacacttacggggcacctccagctagaatatcagtgccctacgtgggcattgccaatgcatattctcatttttacgatgggtttgccaaagtaccactagcaggccaagcctcaacagagggtgactcgctgtatggagcggcttcattgaatgacttcggatcactggctgttcgagtggtgaatgaccacaaccctacgaaactcacttcaaaaatcagagtgtacatgaaaccaaagcacgtcagagtgtggtgtccgcgaccccctcgagcagtcccatactacggaccaggggttgactacaaggatggactagccccactgccagagaaaggcttgacaacctatggttttggccaccaaaataaggcagtgtacacggcaggttacaaaatttgcaattaccacctcgccacccaggaagacttacaaaatgcggtaaacattatgtggattagagaccttttagtagtggaatccaaagcccaaggcatagactcaattgctagatgtaactgccacactggagtgtactactgtgaatccaggaggaagtactacccggtctcttttactggccccacctttcagtacatggaagcaaatgagtactatccagcccgataccaatcccacatgttaattggccatggttttgcatctccaggggactgtggtgggattctcaggtgccaacatggagtaattggaatcattacagctggaggagaaggcctagtcgctttctcggacatcagagatctgtacgcatacgaggaggaggctatggagcagggagtctccaactatattgagtcccttggggctgcatttgggagtggattcacccagcaaataggaaacaaaatttcagaactcactagcatggtcaccagcactataactgagaaactactaaagaatctcattaaaataatttcatcccttgttatcatcaccagaaactatgaagacacgaccacagtgctggctacccttgctctcctcggttgtgatgcgtccccatggcaatggctaaagaagaaagcctgtgacatcttggaaatcccctacatcatgcgacagggcgatagctggttgaagaagtttacagaggcatgcaatgcagccaagggattggaatgggtgtctaataaaatatccaaatttattgactggctcaaagagaagatcattccacaggctagagacaagctagagtttgttaccaaactgaagcaactagaaatgttggagaaccaaattgcaaccattcatcaatcgtgcccaagtcaggagcatcaagaaatcctgttcaataacgtgagatggttatccatacagtcaaagagatttgccccgctctatgcggttgaggctaagagaatacaaaagttagagcacacgattaacaactacgtacagttcaagagcaaacaccgtattgaaccagtatgtttgttggtgcacggtagcccaggcacgggcaagtcagttgccaccaatttaattgccagagcaatagcagagaaggagaacacctccacatactcactaccaccagatccctcccatttcgatgggtacaagcaacaaggtgtggtgatcatggatgatttgaatcagaacccagacggagcagacatgaagctgttttgtcagatggtctccactgtagaattcataccaccaatggcttcgctagaagaaaagggtattttgttcacatctaattacgttttggcctcaaccaattccagtcgcatcaccccaccaactgttgcgcacagcgatgccctagccaggcgctttgcatttgacatggacatacaaatcatgagcgagtattctagagatggaaaattgaacatggcgatggcaactgaaatgtgtaagaactgtcatcaaccagcaaacttcaagagatgttgcccattggtgtgtggcaaagccatccagctgatggacaaatcttccagagtcagatatagtatagatcagattactaccatgattattaatgagaggaacagaagatcaagtatcggtaattgcatggaggcacttttccaaggtcctcttcaatacaaagacctgaaaatagacattaagaccacacctcctcctgagtgcatcaatgatttgctccaagcagttgattctcaagaggtaagagactactgtgagaagaagggttggatagtagacatcactagtcaggtgcaaaccgaaagaaacatcaatagagcaatgactattcttcaggcggtcaccacatttgccgcagttgctggagtggtgtatgtgatgtacaaactctttgcagggcatcaaggagcgtatacagggcttcccaataagagacccaatgtccccaccatcaggactgccaaggttcagggcccaggatttgactacgcagtggcaatggccaaaagaaacattcttacggcaactaccattaagggagagttcacaatgctcggagtgcatgataatgtggccattctaccaacccacgcatcaccgggtgaaacaatagtcattgatggcaaggaagtagaggtactggatgctaaagccctggaggaccaggccgggaccaacctagaaatcaccattgtcactcttaagagaaatgagaagttcagggacatcagaccacacatccccactcaaatcactgagacaaatgatggagttttaattgtgaacactagtaagtaccccaacatgtatgttcctgtcggtgctgtgactgaacaggggtatctcaatctcggtggacgccaaactgctcgtactttaatgtacaactttccaacgagagcaggtcaatgtggtggagttatcacctgcactggcaaggtcatcgggatgcatgttggtgggaacggttcacatgggttcgcagcagccctgaagcgatcctatttcactcagagtcaaggtgaaatccagtggatgagaccatcaaaagaagtgggctaccccgttattaatgctccatctaaaactaaactggaacccagtgcattccattatgtgtttgaaggtgtcaaggaaccagctgtgctcaccaaaagtgaccccagattgaagacagattttgaagaggctatcttttccaagtatgtgggaaataagattactgaagtggatgagtacatgaaagaagctgtcgatcattacgcaggccagctcatgtcactagacatcaacacagaacaaatgtgccttgaggatgcaatgtatggcactgacggtctcgaagctctagacctcagtaccagtgctgggtatccctatgtggcaatggggaaaaagaaaagagacattttgaataagcaaaccagagacacaaaggaaatgcaaaggcttctggacacctatggtattaatttacctttagtcacctatgtgaaagatgagcttagatccaagaccaaagtggaacagggcaagtccaggctaattgaggcctcaagtctcaatgactctgtcgccatgaggatggcttttggcaacttgtacgcagcattccacaagaacccaggtgtagtgacaggatcggctgttggctgtgacccagatttgttttggagtaaaataccagtcctcatggaggaaaaactctttgcatttgattacacgggttatgatgcttcactaagccccgcctggtttgaggctctcaagatggttctagagaaaattgggtttggtgacagagtggattacattgattatctgaatcactcgcaccatctatataaaaataagacatattgtgttaagggcggcatgccatctggctgctctggcacctcaatttttaattcaatgattaataatctaataatcaggactctcttactgaaaacctacaagggcatagatttagaccacctgaagatgatagcctatggtgatgatgtaattgcttcctacccccatgaggttgatgctagtctcctagcccaatcaggaaaagactatggactaaccatgacaccagctgacaaatcagccacctttgaaacagtcacatgggagaatgtaacattcttgaaaagattctttagagcagatgaaaagtatccctttctggtacatccagtgatgccaatgaaagaaattcacgaatcaattagatggactaaagatcccagaaacactcaggatcatgttcgctcactgtgcttattggcttggcacaatggcgaggaagagtacaataaatttttagctaagattagaagtgtgccaatcggaagagcattactgctccctgagtactccacattgtaccgccgttggctcgactcattttagtaaccctacctcagtcgaattggattgggtcatactgttgtaggggtaaatttttctttaattcggag

SEQ ID NO: 57 - DNA, 7439 bp, Artificial
  deoptimized MEF1 poliovirus
ttaaaacagctctggggttgttcccaccccagaggcccacgtggcggccagtacactggtattgcggtacctttgtacgcctgttttatactcccttcccccgtaacttagaagcacaatgtccaagttcaataggagggggtacaaaccagtaccaccacgaacaagcacttctgttcccccggtgaggctgtataggctgtttccacggctaaaagcggctgatccgttatccgctcatgtacttcgagaagcctagtatcaccttggaatcttcgatgcgttgcgctcaacactcaaccccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacctgagagtcctccggcccctgaatgcggctaatcctaaccacggagcaggcagtggcaatccagcgaccagcctgtcgtaacgcgcaagttcgtggcggaaccgactactttgggtgtccgtgtttccttttatttttacaatggctgcttatggtgacaatcattgattgttatcataaagcaaattggattggccatccggtgagaatttgattattaaattactctcttgttgggattgctcctttgaaatcctgtgcactcacacctattggaattacctcattgttaagatatcatcaccactatgggtgcgcaagtcagcagccagaaagtcggtgcgcatgagaatagcaaccgggcgtatggtggtagcacgatcaattacacgacgatcaattattaccgggatagcgcgagcaatgcggcgagcaagcaggactttgcgcaagacccgagcaagttcacggaaccgatcaaagatgtccttatcaagacggcgccgacgcttaacagcccgaatatcgaggcgtgtggttatagcgaccgggtcatgcaacttacgcttggtaatagcacgatcacgacgcaggaggcggcgaatagcgtcgtcgcgtacggccggtggccggagtacatcaaggacagcgaagcgaatccggtggaccagccgacggaaccggacgtcgcggcgtgccggttttacacgcttgacacggtcacgtggcggaaggagagccggggttggtggtggaaacttccggatgcgcttaaggacatgggtcttttcggtcagaacatgttctaccactaccttggtcgggcgggttatacggtccacgtccagtgtaatgcgagcaagtttcaccagggtgcgcttggtgtcttcgcggtcccggaaatgtgccttgcgggtgacagcacgacgcacatgtttacgaaatatgagaatgcgaatccgggtgagaaaggtggtgaattcaaaggtagctttacgcttgatacgaacgcgacgaacccggcgcggaacttttgtccggtcgattatcttttcggtagcggtgtccttgcgggtaatgcgtttgtctacccgcatcagatcatcaatcttcggacgaacaactgtgcgacgcttgtccttccgtacgtcaatagccttagcatcgacagcatgacgaaacacaacaattggggtatcgcgatccttccgcttgcgccgcttgactttgcgacggagagcagcacggagatcccgatcacgcttacgatcgcgccgatgtgttgtgaattcaatggtcttcggaacatcacggtcccgcggacgcaaggtctaccggtccttaacacgccgggtagcaaccagtaccttacggcggacaactatcaaagcccgtgtgcgatcccggagtttgatgtcacgccgccgatcgacatcccgggtgaagtccggaacatgatggaacttgcggagatcgacacgatgatcccgcttaatcttacgaaccagcggaagaacacgatggatatgtaccgggtcgaacttaatgatgcggcgcacagcgacacgccgatcctttgtcttagccttagcccggcgagcgatccgcggctagcgcacacgatgcttggtgaaatccttaactactacacgcactgggcgggtagccttaagttcacgtttcttttctgcggtagcatgatggcgacgggtaaacttcttgtcagctatgcgccgccgggtgcggaagcgccgaaaagccggaaagaagcgatgcttggtacgcacgtcatctgggacatcggtcttcagagcagctgcacgatggtcgtcccgtggatcagcaacacgacgtaccggcaaacgatcaacgatagcttcacggaaggtggttacatcagcatgttttaccaaacgcgggtcgtcgtcccgcttagcacgccgcggaagatggacatccttggttttgtcagcgcgtgcaatgacttcagcgtccggcttcttcgggacacgacgcacatcagccaagaggcgatgccgcaaggtcttggtgatcttatcgaaggtgtcgtcgagggtgtcacgcggaatgcgcttacgccgcttacgccggcgaacaaccttccggatacgcaaagcagcggtccggcgcacagcaaggaaacgccagcgctaacagccgtagagacaggggccaccaacccattggtgccttcagacacggtacaaactcgtcacgtcatccaaaagcggacgcggtcggagtctacggttgagtctttcttcgcaagaggagcttgtgtggccattattgaagtggataatgatgctccaacaaagcgtgccagtaaattattttcagtctggaagataacttacaaagacaccgttcagttaagacgtaagttggagttctttacatattcaaggtttgacatggagttcacctttgtggttacatccaattataccgatgcaaacaatgggcacgcactaaatcaagtttaccagataatgtacataccacctggggcaccgatccctggcaagtggaatgattacacatggcaaacgtcatctaacccatcagtgttttacacttacggggcacctccagctagaatatcagtgccctacgtgggcattgccaatgcatattctcatttttacgatgggtttgccaaagtaccactagcaggccaagcctcaacagagggtgactcgctgtatggagcggcttcattgaatgacttcggatcactggctgttcgagtggtgaatgaccacaaccctacgaaactcacttcaaaaatcagagtgtacatgaaaccaaagcacgtcagagtgtggtgtccgcgaccccctcgagcagtcccatactacggaccaggggttgactacaaggatggactagccccactgccagagaaaggcttgacaacctatggttttggccaccaaaataaggcagtgtacacggcaggttacaaaatttgcaattaccacctcgccacccaggaagacttacaaaatgcggtaaacattatgtggattagagaccttttagtagtggaatccaaagcccaaggcatagactcaattgctagatgtaactgccacactggagtgtactactgtgaatccaggaggaagtactacccggtctcttttactggccccacctttcagtacatggaagcaaatgagtactatccagcccgataccaatcccacatgttaattggccatggttttgcatctccaggggactgtggtgggattctcaggtgccaacatggagtaattggaatcattacagctggaggagaaggcctagtcgctttctcggacatcagagatctgtacgcatacgaggaggaggctatggagcagggagtctccaactatattgagtcccttggggctgcatttgggagtggattcacccagcaaataggaaacaaaatttcagaactcactagcatggtcaccagcactataactgagaaactactaaagaatctcattaaaataatttcatcccttgttatcatcaccagaaactatgaagacacgaccacagtgctggctacccttgctctcctcggttgtgatgcgtccccatggcaatggctaaagaagaaagcctgtgacatcttggaaatcccctacatcatgcgacagggcgatagctggttgaagaagtttacagaggcatgcaatgcagccaagggattggaatgggtgtctaataaaatatccaaatttattgactggctcaaagagaagatcattccacaggctagagacaagctagagtttgttaccaaactgaagcaactagaaatgttggagaaccaaattgcaaccattcatcaatcgtgcccaagtcaggagcatcaagaaatcctgttcaataacgtgagatggttatccatacagtcaaagagatttgccccgctctatgcggttgaggctaagagaatacaaaagttagagcacacgattaacaactacgtacagttcaagagcaaacaccgtattgaaccagtatgtttgttggtgcacggtagcccaggcacgggcaagtcagttgccaccaatttaattgccagagcaatagcagagaaggagaacacctccacatactcactaccaccagatccctcccatttcgatgggtacaagcaacaaggtgtggtgatcatggatgatttgaatcagaacccagacggagcagacatgaagctgttttgtcagatggtctccactgtagaattcataccaccaatggcttcgctagaagaaaagggtattttgttcacatctaattacgttttggcctcaaccaattccagtcgcatcaccccaccaactgttgcgcacagcgatgccctagccaggcgctttgcatttgacatggacatacaaatcatgagcgagtattctagagatggaaaattgaacatggcgatggcaactgaaatgtgtaagaactgtcatcaaccagcaaacttcaagagatgttgcccattggtgtgtggcaaagccatccagctgatggacaaatcttccagagtcagatatagtatagatcagattactaccatgattattaatgagaggaacagaagatcaagtatcggtaattgcatggaggcacttttccaaggtcctcttcaatacaaagacctgaaaatagacattaagaccacacctcctcctgagtgcatcaatgatttgctccaagcagttgattctcaagaggtaagagactactgtgagaagaagggttggatagtagacatcactagtcaggtgcaaaccgaaagaaacatcaatagagcaatgactattcttcaggcggtcaccacatttgccgcagttgctggagtggtgtatgtgatgtacaaactctttgcagggcatcaaggagcgtatacagggcttcccaataagagacccaatgtccccaccatcaggactgccaaggttcagggcccaggatttgactacgcagtggcaatggccaaaagaaacattcttacggcaactaccattaagggagagttcacaatgctcggagtgcatgataatgtggccattctaccaacccacgcatcaccgggtgaaacaatagtcattgatggcaaggaagtagaggtactggatgctaaagccctggaggaccaggccgggaccaacctagaaatcaccattgtcactcttaagagaaatgagaagttcagggacatcagaccacacatccccactcaaatcactgagacaaatgatggagttttaattgtgaacactagtaagtaccccaacatgtatgttcctgtcggtgctgtgactgaacaggggtatctcaatctcggtggacgccaaactgctcgtactttaatgtacaactttccaacgagagcaggtcaatgtggtggagttatcacctgcactggcaaggtcatcgggatgcatgttggtgggaacggttcacatgggttcgcagcagccctgaagcgatcctatttcactcagagtcaaggtgaaatccagtggatgagaccatcaaaagaagtgggctaccccgttattaatgctccatctaaaactaaactggaacccagtgcattccattatgtgtttgaaggtgtcaaggaaccagctgtgctcaccaaaagtgaccccagattgaagacagattttgaagaggctatcttttccaagtatgtgggaaataagattactgaagtggatgagtacatgaaagaagctgtcgatcattacgcaggccagctcatgtcactagacatcaacacagaacaaatgtgccttgaggatgcaatgtatggcactgacggtctcgaagctctagacctcagtaccagtgctgggtatccctatgtggcaatggggaaaaagaaaagagacattttgaataagcaaaccagagacacaaaggaaatgcaaaggcttctggacacctatggtattaatttacctttagtcacctatgtgaaagatgagcttagatccaagaccaaagtggaacagggcaagtccaggctaattgaggcctcaagtctcaatgactctgtcgccatgaggatggcttttggcaacttgtacgcagcattccacaagaacccaggtgtagtgacaggatcggctgttggctgtgacccagatttgttttggagtaaaataccagtcctcatggaggaaaaactctttgcatttgattacacgggttatgatgcttcactaagccccgcctggtttgaggctctcaagatggttctagagaaaattgggtttggtgacagagtggattacattgattatctgaatcactcgcaccatctatataaaaataagacatattgtgttaagggcggcatgccatctggctgctctggcacctcaatttttaattcaatgattaataatctaataatcaggactctcttactgaaaacctacaagggcatagatttagaccacctgaagatgatagcctatggtgatgatgtaattgcttcctacccccatgaggttgatgctagtctcctagcccaatcaggaaaagactatggactaaccatgacaccagctgacaaatcagccacctttgaaacagtcacatgggagaatgtaacattcttgaaaagattctttagagcagatgaaaagtatccctttctggtacatccagtgatgccaatgaaagaaattcacgaatcaattagatggactaaagatcccagaaacactcaggatcatgttcgctcactgtgcttattggcttggcacaatggcgaggaagagtacaataaatttttagctaagattagaagtgtgccaatcggaagagcattactgctccctgagtactccacattgtaccgccgttggctcgactcattttagtaaccctacctcagtcgaattggattgggtcatactgttgtaggggtaaatttttctttaattcggag

SEQ ID NO: 58 - DNA, 7439 bp, Artificial
  deoptimized MEF1 poliovirus
ttaaaacagctctggggttgttcccaccccagaggcccacgtggcggccagtacactggtattgcggtacctttgtacgcctgttttatactcccttcccccgtaacttagaagcacaatgtccaagttcaataggagggggtacaaaccagtaccaccacgaacaagcacttctgttcccccggtgaggctgtataggctgtttccacggctaaaagcggctgatccgttatccgctcatgtacttcgagaagcctagtatcaccttggaatcttcgatgcgttgcgctcaacactcaaccccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacctgagagtcctccggcccctgaatgcggctaatcctaaccacggagcaggcagtggcaatccagcgaccagcctgtcgtaacgcgcaagttcgtggcggaaccgactactttgggtgtccgtgtttccttttatttttacaatggctgcttatggtgacaatcattgattgttatcataaagcaaattggattggccatccggtgagaatttgattattaaattactctcttgttgggattgctcctttgaaatcctgtgcactcacacctattggaattacctcattgttaagatatcatcaccactatgggtgcgcaagtcagcagccagaaagtcggtgcgcatgagaatagcaaccgggcgtatggtggtagcacgatcaattacacgacgatcaattattaccgggatagcgcgagcaatgcggcgagcaagcaggactttgcgcaagacccgagcaagttcacggaaccgatcaaagatgtccttatcaagacggcgccgacgcttaacagcccgaatatcgaggcgtgtggttatagcgaccgggtcatgcaacttacgcttggtaatagcacgatcacgacgcaggaggcggcgaatagcgtcgtcgcgtacggccggtggccggagtacatcaaggacagcgaagcgaatccggtggaccagccgacggaaccggacgtcgcggcgtgccggttttacacgcttgacacggtcacgtggcggaaggagagccggggttggtggtggaaacttccggatgcgcttaaggacatgggtcttttcggtcagaacatgttctaccactaccttggtcgggcgggttatacggtccacgtccagtgtaatgcgagcaagtttcaccagggtgcgcttggtgtcttcgcggtcccggaaatgtgccttgcgggtgacagcacgacgcacatgtttacgaaatatgagaatgcgaatccgggtgagaaaggtggtgaattcaaaggtagctttacgcttgatacgaacgcgacgaacccggcgcggaacttttgtccggtcgattatcttttcggtagcggtgtccttgcgggtaatgcgtttgtctacccgcatcagatcatcaatcttcggacgaacaactgtgcgacgcttgtccttccgtacgtcaatagccttagcatcgacagcatgacgaaacacaacaattggggtatcgcgatccttccgcttgcgccgcttgactttgcgacggagagcagcacggagatcccgatcacgcttacgatcgcgccgatgtgttgtgaattcaatggtcttcggaacatcacggtcccgcggacgcaaggtctaccggtccttaacacgccgggtagcaaccagtaccttacggcggacaactatcaaagcccgtgtgcgatcccggagtttgatgtcacgccgccgatcgacatcccgggtgaagtccggaacatgatggaacttgcggagatcgacacgatgatcccgcttaatcttacgaaccagcggaagaacacgatggatatgtaccgggtcgaacttaatgatgcggcgcacagcgacacgccgatcctttgtcttagccttagcccggcgagcgatccgcggctagcgcacacgatgcttggtgaaatccttaactactacacgcactgggcgggtagccttaagttcacgtttcttttctgcggtagcatgatggcgacgggtaaacttcttgtcagctatgcgccgccgggtgcggaagcgccgaaaagccggaaagaagcgatgcttggtacgcacgtcatctgggacatcggtcttcagagcagctgcacgatggtcgtcccgtggatcagcaacacgacgtaccggcaaacgatcaacgatagcttcacggaaggtggttacatcagcatgttttaccaaacgcgggtcgtcgtcccgcttagcacgccgcggaagatggacatccttggttttgtcagcgcgtgcaatgacttcagcgtccggcttcttcgggacacgacgcacatcagccaagaggcgatgccgcaaggtcttggtgatcttatcgaaggtgtcgtcgagggtgtcacgcggaatgcgcttacgccgcttacgccggcgaacaaccttccggatacgcaaagcagcggtccggcgcacagcaaggaaacgccagcgcttacggcggtcgagacgggtgcgacgaacccgcttgtcccgagcgacacggtccaaacgcggcacgtcatccaaaagcggacgcggagcgagagcacggtcgagagcttcttcgcgcggggtgcgtgtgtcgcgatcatcgaagtcgataatgatgcgccgacgaagcgggcgagcaaactttttagcgtctggaagatcacgtacaaagacacggtccagcttcggcggaagctggagttctttacgtatagccggtttgacatggagttcacgtttgtcgtcacgagcaattatacggatgcgaacaatggtcacgcgcttaatcaagtctaccagatcatgtacatcccgccgggtgcgccgatcccgggtaagtggaatgattacacgtggcaaacgagcagcaacccgagcgtcttttacacgtacggtgcgccgccggcgcggatcagcgtcccgtacgtcggtatcgcgaatgcgtatagccatttttacgatggttttgcgaaagtcccgcttgcgggtcaagcgagcacggagggtgacagcctttatggtgcggcgagccttaatgacttcggtagccttgcggtccgggtcgtcaatgaccacaacccgacgaaacttacgagcaaaatccgggtctacatgaaaccgaagcacgtccgggtctggtgtccgcggccccctcgagcagtcccatactacggaccaggggttgactacaaggatggactagccccactgccagagaaaggcttgacaacctatggttttggccaccaaaataaggcagtgtacacggcaggttacaaaatttgcaattaccacctcgccacccaggaagacttacaaaatgcggtaaacattatgtggattagagaccttttagtagtggaatccaaagcccaaggcatagactcaattgctagatgtaactgccacactggagtgtactactgtgaatccaggaggaagtactacccggtctcttttactggccccacctttcagtacatggaagcaaatgagtactatccagcccgataccaatcccacatgttaattggccatggttttgcatctccaggggactgtggtgggattctcaggtgccaacatggagtaattggaatcattacagctggaggagaaggcctagtcgctttctcggacatcagagatctgtacgcatacgaggaggaggctatggagcagggagtctccaactatattgagtcccttggggctgcatttgggagtggattcacccagcaaataggaaacaaaatttcagaactcactagcatggtcaccagcactataactgagaaactactaaagaatctcattaaaataatttcatcccttgttatcatcaccagaaactatgaagacacgaccacagtgctggctacccttgctctcctcggttgtgatgcgtccccatggcaatggctaaagaagaaagcctgtgacatcttggaaatcccctacatcatgcgacagggcgatagctggttgaagaagtttacagaggcatgcaatgcagccaagggattggaatgggtgtctaataaaatatccaaatttattgactggctcaaagagaagatcattccacaggctagagacaagctagagtttgttaccaaactgaagcaactagaaatgttggagaaccaaattgcaaccattcatcaatcgtgcccaagtcaggagcatcaagaaatcctgttcaataacgtgagatggttatccatacagtcaaagagatttgccccgctctatgcggttgaggctaagagaatacaaaagttagagcacacgattaacaactacgtacagttcaagagcaaacaccgtattgaaccagtatgtttgttggtgcacggtagcccaggcacgggcaagtcagttgccaccaatttaattgccagagcaatagcagagaaggagaacacctccacatactcactaccaccagatccctcccatttcgatgggtacaagcaacaaggtgtggtgatcatggatgatttgaatcagaacccagacggagcagacatgaagctgttttgtcagatggtctccactgtagaattcataccaccaatggcttcgctagaagaaaagggtattttgttcacatctaattacgttttggcctcaaccaattccagtcgcatcaccccaccaactgttgcgcacagcgatgccctagccaggcgctttgcatttgacatggacatacaaatcatgagcgagtattctagagatggaaaattgaacatggcgatggcaactgaaatgtgtaagaactgtcatcaaccagcaaacttcaagagatgttgcccattggtgtgtggcaaagccatccagctgatggacaaatcttccagagtcagatatagtatagatcagattactaccatgattattaatgagaggaacagaagatcaagtatcggtaattgcatggaggcacttttccaaggtcctcttcaatacaaagacctgaaaatagacattaagaccacacctcctcctgagtgcatcaatgatttgctccaagcagttgattctcaagaggtaagagactactgtgagaagaagggttggatagtagacatcactagtcaggtgcaaaccgaaagaaacatcaatagagcaatgactattcttcaggcggtcaccacatttgccgcagttgctggagtggtgtatgtgatgtacaaactctttgcagggcatcaaggagcgtatacagggcttcccaataagagacccaatgtccccaccatcaggactgccaaggttcagggcccaggatttgactacgcagtggcaatggccaaaagaaacattcttacggcaactaccattaagggagagttcacaatgctcggagtgcatgataatgtggccattctaccaacccacgcatcaccgggtgaaacaatagtcattgatggcaaggaagtagaggtactggatgctaaagccctggaggaccaggccgggaccaacctagaaatcaccattgtcactcttaagagaaatgagaagttcagggacatcagaccacacatccccactcaaatcactgagacaaatgatggagttttaattgtgaacactagtaagtaccccaacatgtatgttcctgtcggtgctgtgactgaacaggggtatctcaatctcggtggacgccaaactgctcgtactttaatgtacaactttccaacgagagcaggtcaatgtggtggagttatcacctgcactggcaaggtcatcgggatgcatgttggtgggaacggttcacatgggttcgcagcagccctgaagcgatcctatttcactcagagtcaaggtgaaatccagtggatgagaccatcaaaagaagtgggctaccccgttattaatgctccatctaaaactaaactggaacccagtgcattccattatgtgtttgaaggtgtcaaggaaccagctgtgctcaccaaaagtgaccccagattgaagacagattttgaagaggctatcttttccaagtatgtgggaaataagattactgaagtggatgagtacatgaaagaagctgtcgatcattacgcaggccagctcatgtcactagacatcaacacagaacaaatgtgccttgaggatgcaatgtatggcactgacggtctcgaagctctagacctcagtaccagtgctgggtatccctatgtggcaatggggaaaaagaaaagagacattttgaataagcaaaccagagacacaaaggaaatgcaaaggcttctggacacctatggtattaatttacctttagtcacctatgtgaaagatgagcttagatccaagaccaaagtggaacagggcaagtccaggctaattgaggcctcaagtctcaatgactctgtcgccatgaggatggcttttggcaacttgtacgcagcattccacaagaacccaggtgtagtgacaggatcggctgttggctgtgacccagatttgttttggagtaaaataccagtcctcatggaggaaaaactctttgcatttgattacacgggttatgatgcttcactaagccccgcctggtttgaggctctcaagatggttctagagaaaattgggtttggtgacagagtggattacattgattatctgaatcactcgcaccatctatataaaaataagacatattgtgttaagggcggcatgccatctggctgctctggcacctcaatttttaattcaatgattaataatctaataatcaggactctcttactgaaaacctacaagggcatagatttagaccacctgaagatgatagcctatggtgatgatgtaattgcttcctacccccatgaggttgatgctagtctcctagcccaatcaggaaaagactatggactaaccatgacaccagctgacaaatcagccacctttgaaacagtcacatgggagaatgtaacattcttgaaaagattctttagagcagatgaaaagtatccctttctggtacatccagtgatgccaatgaaagaaattcacgaatcaattagatggactaaagatcccagaaacactcaggatcatgttcgctcactgtgcttattggcttggcacaatggcgaggaagagtacaataaatttttagctaagattagaagtgtgccaatcggaagagcattactgctccctgagtactccacattgtaccgccgttggctcgactcattttagtaaccctacctcagtcgaattggattgggtcatactgttgtaggggtaaatttttctttaattcggag

SEQ ID NO: 59 - DNA, 23 bp, Artificial
  primer
attggcacactcctgattttagc

SEQ ID NO: 60 - DNA, 22 bp, Artificial
  primer
caaaggatcccagaaacacaca

SEQ ID NO: 61 - DNA, 23 bp, Artificial
  TaqMan probe
ttcttcttcgccgttgtgccagg

SEQ ID NO: 62 - DNA, 22 bp, Artificial
  primer
ctaaagatcccagaaacactca

SEQ ID NO: 63 - DNA, 23 bp, Artificial
  primer
attggcacacttctaatcttagc

SEQ ID NO: 64 - DNA, 23 bp, Artificial
  probe
ctcttcctcgccattgtgccaag

SEQ ID NO: 65 - DNA, 690 bp, Artificial
  Sabin 2 sequence with decreased number of CG dinucleotides
acggccgtggagacaggggctaccaatccattggtgccttcagacactgtgcaaactagacatgtcatccagagaagaactagatcagagtccactgttgagtcattctttgcaagaggggcttgtgtggctatcattgaggtggacaatgatgcaccaacaaagagagccagcagattgttttcagtttggaaaataacttacaaagatactgttcaactgagaagaaaactggaatttttcacatattcaagatttgacatggagttcacttttgtggtcacctcaaactacattgatgcaaataatggacatgcattgaaccaagtttatcagataatgtatataccaccaggagcacctatccctggtaaatggaatgactatacttggcagacttcctctaacccatcagtgttttacacctatggggcacccccagcaagaatatcagtgccctatgtgggaattgctaatgcatattcccacttttatgatgggtttgcaaaagtaccactagcaggtcaagcctcaactgaaggtgattcattgtatggtgctgcctcactgaatgattttggatcactggctgttagagtggtaaatgatcacaaccccactaggctcacctccaagatcagagtgtacatgaagccaaagcatgtcagagtctggtgcccaagacctcct

SEQ ID NO: 66 - DNA, 690 bp, Artificial
  Sabin 2 sequence with reduced number of CG and TA dinucleotides
acggccgtggagacaggggcaaccaatccattggtgccttcagacactgtgcaaacaagacatgtcatccagagaagaacaagatcagagtccactgttgagtcattctttgcaagaggggcttgtgtggcaatcattgaggtggacaatgatgcaccaacaaagagagccagcagattgttttcagtttggaaaatcacttacaaagacactgttcaactgagaagaaaactggaatttttcacatattcaagatttgacatggagttcacttttgtggtcacctcaaactacattgatgcaaacaatggacatgcattgaaccaagtttatcagatcatgtacattccaccaggagcaccaatccctggaaaatggaatgactacacttggcagacttcctcaaacccatcagtgttttacacctatggggcacccccagcaagaatttcagtgccctatgtgggaattgcaaatgcatattcccacttttatgatgggtttgcaaaagtgccactggcaggtcaagcctcaactgaaggtgattcattgtatggtgctgcctcactgaatgattttggatcactggctgtgagagtggtgaatgatcacaaccccacaaggctcacctccaagatcagagtgtacatgaagccaaagcatgtcagagtctggtgcccaagacctcct

SEQ ID NO: 67 - DNA, 690 bp, Artificial
  Sabin 2 sequence with increased CG dinucleotide content
acggccgtcgagacgggcgcgacgaatccgctcgtgccgtcggacaccgtgcaaacgcgccacgtcatccagcgacgaacgcgatcggagtcgacggtcgagtcgttcttcgcgcgcggcgcgtgcgtcgcgatcatcgaggtcgacaacgacgcgccgacgaagcgcgcgtcgcgattgttttcggtttggaaaataacgtacaaagatacggttcaactgcgacgcaaactcgaatttttcacgtattcgcgattcgacatggagttcacgttcgtcgtcacgtcgaactacatcgacgcgaataacggacacgcgttgaaccaagtttatcagataatgtatataccgcccggcgcgccgatcccgggtaaatggaacgactatacgtggcagacgtcgtcgaacccgtcggtgttttacacgtacggcgcgccgccggcgcgaatatcggtgccgtacgtcggaatcgcgaacgcgtattcgcacttttacgacgggttcgcgaaagtaccgctcgcgggtcaagcgtcgacggaaggcgattcgttgtacggcgcggcgtcgctgaacgatttcggatcgctcgcggttcgcgtcgtaaacgatcacaacccgacgcggctcacgtcgaagatccgcgtgtacatgaagccgaagcacgtccgcgtctggtgcccgcgaccgcct

SEQ ID NO: 68 - DNA, 690 bp, Artificial
  Sabin 2 sequence with increased numbers of CG and TA dinucleotides
acggccgtcgagacgggcgcgacgaatccgctcgtaccgtcggataccgtacaaacgcgccacgtaatacagcgacgtacgcgtagcgagtcgacggtcgagtcgttcttcgcgcgcggcgcgtgcgtcgcgattatcgaggtcgataacgacgcgccgacgaagcgcgcgtcgcgattattttcggtatggaaaataacgtataaagatacggtacaactacgacgtaaactcgaattttttacgtattcgcgattcgatatggagtttacgttcgtcgttacgtcgaactatatcgacgcgaataacggacacgcgttaaaccaagtatatcagataatgtatataccgcccggcgcgccgatcccgggtaaatggaacgactatacgtggcagacgtcgtcgaacccgtcggtattttatacgtacggcgcgccgccggcgcgtatatcggtaccgtacgtcggtatcgcgaacgcgtattcgcacttttacgacgggttcgcgaaagtaccgctcgcgggtcaagcgtcgacggaaggcgattcgttatacggcgcggcgtcgcttaacgatttcggatcgctcgcggtacgcgtcgtaaacgatcataacccgacgcggcttacgtcgaagatacgcgtatatatgaagccgaagcacgtacgcgtatggtgcccgcgaccgcct

SEQ ID NO: 69 - DNA, 690 bp, Artificial
  exemplary deoptimized Sabin 2 sequence
acggccgtcgagacgggtgcgacgaatccgcttgtcccgtcggacacggtccaaacgcggcatgtcatacagcggcggacgcggtcggagtcgacggtcgagtcgttctttgcgcggggtgcgtgcgtcgcgataatagaggtggacaatgatgcgccgacgaaacgggcgtcgcggcttttttcggtctggaaaataacgtacaaagatacggtccaacttcggcggaaacttgaatttttcacgtattcgcggtttgacatggagttcacgtttgtcgtcacgtcgaactacatagatgcgaataacggtcatgcgctgaaccaagtctatcagataatgtatataccgccgggtgcgccgataccgggtaaatggaatgactatacgtggcagacgtcgtcgaacccgtcggtcttttacacgtatggtgcgccgccggcgcggatctcggtcccgtacgtcggtatcgcgaatgcgtattcgcatttttatgatggttttgcgaaagtcccgcttgcgggtcaagcgtcgacggaaggtgattcgctttacggtgcggcgtcgcttaatgattttggttcgcttgcggtccgggtcgtcaatgatcataacccgacgcggcttacgtcgaaaatacgggtctacatgaagccgaaacatgtccgggtctggtgcccgcggcctcct

SEQ ID NO: 70 - DNA, 690 bp, Artificial
  Sabin 2 sequence that include MEF1 codons
acggccgtagagacaggggccaccaacccattggtgccttcagacacggtacaaactcgtcacgtcatccaaagacggacgcggtcggagtctacggttgagtctttcttcgcaagaggagcttgtgtggccattattgaagtggataatgatgctccaacaaagcgtgccagtagattattttcagtctggaagataacttacaaagacaccgttcagttaagacgtaagttggagttctttacatattcaaggtttgacatggagttcacctttgtggttacatccaattatattgatgcaaacaatgggcacgcactaaatcaagtttaccagataatgtacataccacctggggcaccgatccctggcaagtggaatgattacacatggcaaacgtcatctaacccatcagtgttttacacttacggggcacctccagctagaatatcagtgccctacgtgggcattgccaatgcatattctcatttttacgatgggtttgccaaagtaccactagcaggccaagcctcaacagagggtgactcgctgtatggagcggcttcattgaatgacttcggatcactggctgttcgagtggtgaatgaccacaaccctacgcggctcacttcaaaaatcagagtgtacatgaaaccaaagcacgtcagagtgtggtgtccgcgaccccct

SEQ ID NO: 71 - DNA, 29751 bp, Coronilla varia
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgcgcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttagatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaaaaa

SEQ ID NO: 72 - DNA, 29745 bp, SARS coronavirus
tattaggtttttacctacccaggaaaagccaaccgacctcgatctcttgtggatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagttcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtctttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagtcttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaacaaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtaatactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaaatgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttagatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgagaagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggcttctaccgaagagctacccgacgagttcgtggtggtgacggcaaaatgaaagagctcagccccagatggtacttctattacctaggaactggcccagaagcttcacttccctacggtgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctaggtagagctgcctatatggaagagccctaatgtgtaaaattaattttagtagtgctatccccatgtgattttaatagcttcttaggagaatgacaaaaaaaaaaaaaaaaaaa

SEQ ID NO: 73 - DNA, 29716 bp, SARS coronavirus
aggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttacaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagtcttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgcwatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgstgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactaraggagctactgtggtaattggaacaagcaagttttacggtggctggcataatatgttaaaaactgtttacagtgatgtaraaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgckaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcaraattatggtgaaaatgctgttataccaaaaggaataatgatkaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttgaatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagatccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccraaacttttcatcagacaagaggaggttcracaagagctctactcgccactttttctcattgttgctgctctagtatttttaatactttgcttcaccattaagagaaagacagaatgaatgagctcactttaattttaattgacttctatttgtgctttttagcctttctgctattccttgttttaataatgcttattatattttggttttcactcgaaatccaggatctagaagaaccctgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctmatgttactatcaactgtcaagatccagctggtggtgcgcttatagctaggtgttggtaccttcatgaaggtcaccaaactgctgcatttagagacgtacttgttgttttaaataaacgaacaaatkaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaa

SEQ ID NO: 74 - DNA, 29728 bp, SARS coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcgggaactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccataggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatagagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtagtgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagcaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccaattgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccgggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctggtagtccttgtgagtctcatggcaaacaagtagtgtcggatattgattatgttccactcaaatctgctacgtgtattacacgatgcaatttaggtggtgctgtttgcagacaccatgcgaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagaccacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcccttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgttgtctacagaattaattgggtgactggcgggattgcgattgcaatggcttgtattgtaggcttgatgtggcttagctacttcgttgcttccctcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgctccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaa

SEQ ID NO: 75 - DNA, 29715 bp, SARS coronavirus
  misc_feature (15311)..(15311): n is a, c, g, or t
  misc_feature (15884)..(15884): n is a, c, g, or t
  misc_feature (16262)..(16364): n is a, c, g, or t
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcattcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacattgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccwaaatgtgacagagccatgcctaacatgcttaggataatggcctctcttgttcttgctcgcaaacataacwcttgcygtaacttatcacaccgtttntacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgtttngtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactttgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattctgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcgctctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttctggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaatgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataawcgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaa

SEQ ID NO: 76 - DNA, 29720 bp, SARS coronavirus
atattaggtaaccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactttgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattctgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcgctctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaatattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgtcggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgttaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgaca

SEQ ID NO: 77 - DNA, 29719 bp, SARS coronavirus
tttctctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcactcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttactgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgatcaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatattttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactttgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattctgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcgctctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcatactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcccattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgttaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaa

SEQ ID NO: 78 - DNA, 29577 bp, SARS coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtgtcattcttggctcaccttcaatggttttgccatgtattctcctattgtgcctttttggataacagcaatctatgtattctgtatttctctgaagcactgccattggttctttaacaactattttagggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaagagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactttgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattctgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcgctctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgaca

SEQ ID NO: 79 - DNA, 29712 bp, SARS coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcactcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttactgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgatcaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttttttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactttgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattctgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcgctctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgtagcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcaccagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgttaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgaca

SEQ ID NO: 80 - DNA, 29713 bp, SARS coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccrgagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacataggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagttaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatattgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgaca

SEQ ID NO: 81 - DNA, 29710 bp, SARS coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccrgagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacataggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagttaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacattggtgctggcgctgctcttcaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatattgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttctaggaagaatga

SEQ ID NO: 82 - DNA, 29725 bp, SARS coronavirus
tacccagggggaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactacttttgaatgactttaaccttgtggcaatgaagtacaactatgaaccttttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttcctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctacttttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaatagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtactgttttgctatccatgcagggtgctgtagacattaataggttgtgcgaggaaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccrgagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacataggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatggggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagttaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatattgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttctaggagaaaatgaca

SEQ ID NO: 83 - DNA, 29717 bp, SARS coronavirus
  misc_feature (13069)..(13069): n is a, c, g, or t
  misc_feature (13075)..(13075): n is a, c, g, or t
  misc_feature (23264)..(23268): n is a, c, g, or t
  misc_feature (25165)..(25165): n is a, c, g, or t
  misc_feature (25181)..(25181): n is a, c, g, or t
  misc_feature (25186)..(25187): n is a, c, g, or t
  misc_feature (25196)..(25196): n is a, c, g, or t
  misc_feature (25199)..(25199): n is a, c, g, or t
  misc_feature (25202)..(25203): n is a, c, g, or t
  misc_feature (25205)..(25205): n is a, c, g, or t
  misc_feature (25209)..(25209): n is a, c, g, or t
  misc_feature (25212)..(25212): n is a, c, g, or t
  misc_feature (25216)..(25216): n is a, c, g, or t
  misc_feature (25224)..(25224): n is a, c, g, or t
  misc_feature (25233)..(25233): n is a, c, g, or t
  misc_feature (25235)..(25235): n is a, c, g, or t
  misc_feature (25238)..(25238): n is a, c, g, or t
  misc_feature (25240)..(25240): n is a, c, g, or t
  misc_feature (25244)..(25244): n is a, c, g, or t
  misc_feature (25251)..(25251): n is a, c, g, or t
  misc_feature (25258)..(25258): n is a, c, g, or t
  misc_feature (25266)..(25266): n is a, c, g, or t
  misc_feature (25269)..(25269): n is a, c, g, or t
  misc_feature (25271)..(25271): n is a, c, g, or t
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactacttttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaaactgtgtgangatgtngtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaaatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggacttttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccrgagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacataggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattcgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacgaggtagacctttttagaaacgcccgtaatggtgttttaataacagaaggttcagtcaaaggtctaacaccttcaaagggaccagcacaagctagcgtcaaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagtnnnnnttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaaatctattgtggcttatactatgtctttaggtgctgatagttcaaattgcttactctaataacaccattgctatacctactaacttttcaaattagcattactacagaaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagttaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaaatcttgctttgttgatgctagttgttgcagttgcctcanggggctgctcttgtgnttctnnctttgatgnggntgnntntganccngttntcaagggngtcaaattncnttncncatnaacgaanttatggntttgtttntgngnttttttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatattgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaasacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaa

SEQ ID NO: 84 - DNA, 29714 bp, SARS coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcaccatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccrgagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacataggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagttaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagatttttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatattgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgaca

SEQ ID NO: 85 - DNA, 29751 bp, SARS coronavirus; identical to SEQ ID NO: 71

SEQ ID NO: 86 - DNA, 29727 bp, SARS coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagttcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgctactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggagctcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagctcgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacaccccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

We claim:

1. A modified coronavirus, comprising:
   a spike glycoprotein coding sequence of the coronavirus, wherein at least twenty codons in the coding sequence are deoptimized as compared to its native coding sequence,
   wherein the at least twenty deoptimized codons are each a synonymous codon less frequently used in the native coronavirus, wherein the synonymous codon less frequently used in the native coronavirus is a codon that encodes the same amino acid, but the codon is an unpreferred codon by the native coronavirus for the amino acid.

2. The modified coronavirus of claim 1, wherein the deoptimized spike glycoprotein coding sequence comprises at least 50% of the coding sequence having synonymous codons less frequently used in the native coronavirus compared to the native coding sequence.

3. The modified coronavirus of claim 1, wherein G+C content in the deoptimized spike glycoprotein coding sequence is altered by at least 20% compared to the native coding sequence.

4. The modified coronavirus of claim 3, wherein the G+C content in the deoptimized spike glycoprotein coding sequence is increased by at least 40%, is increased by at least 48%, or is decreased by at least 40% compared to the native coding sequence.

5. The modified coronavirus of claim 1, wherein the number of CG dinucleotides, TA dinucleotides, or CG dinucleotides and TA nucleotides in the deoptimized spike glycoprotein coding sequence is altered by at least 20% compared to the native coding sequence.

6. The modified coronavirus of claim 5, wherein the number of CG dinucleotides or TA dinucleotides in the deoptimized spike glycoprotein coding sequence is increased by at least 100% compared to the native coding sequence.

7. The modified coronavirus of claim 1, wherein the deoptimized spike glycoprotein coding sequence comprises a coding sequence having an increased number of CG dinucleotides, TA dinucleotides, or CG dinucleotides and TA nucleotides in the coding sequence compared to the native coding sequence, wherein the CG or TA dinucleotides fall across codon boundaries.

8. The modified coronavirus of claim 1, wherein the deoptimized spike glycoprotein coding sequence comprises the nucleic acid sequence of SEQ ID NO: 14.

9. The modified coronavirus of claim 1, wherein the native coding sequence is a coronavirus having GenBank Accession No. NC_004718 (SEQ ID NO: 71), AY654624 (SEQ ID NO: 72), AY595412 (SEQ ID NO: 73), AY394850 (SEQ ID NO: 74), AY559097 (SEQ ID NO: 75), AY559096 (SEQ ID NO: 76), AY559095 (SEQ ID NO: 77), AY559094 (SEQ ID NO: 78), AY559093 (SEQ ID NO: 79), AY559092 (SEQ ID NO: 80), AY559091 (SEQ ID NO: 81), AY559090 (SEQ ID NO: 82), AY559089 (SEQ ID NO: 83), AY559088 (SEQ ID NO: 84), AY274119 (SEQ ID NO: 85), or AY278741 (SEQ ID NO: 86).

10. The modified coronavirus of claim 1, wherein the deoptimized codons in the deoptimized spike glycoprotein coding sequence comprises at least 30 deoptimized codons in the spike glycoprotein coding sequence as compared to the native coding sequence and each deoptimized codon is a synonymous codon less frequently used in the native coronavirus.

11. A method of eliciting an immune response against a coronavirus in a subject, comprising administering to the subject an immunologically effective amount of the modified coronavirus of claim 1, thereby eliciting an immune response in the subject.

12. A method of producing a modified coronavirus, comprising:
   introducing the modified coronavirus of claim 1 into a host cell;
   allowing the modified coronavirus to replicate; and
   isolating the replicated modified coronavirus.

* * * * *